US012590300B2

(12) United States Patent  
Williams et al.

(10) Patent No.: US 12,590,300 B2  
(45) Date of Patent: Mar. 31, 2026

(54) TRANSCRIPTION ACTIVATOR-LIKE EFFECTORS FUSED TO INTEINS

(71) Applicant: Cibus US LLC, San Diego, CA (US)

(72) Inventors: Robert W. Williams, Minneapolis, MN (US); Sara Wixon, Minneapolis, MN (US)

(73) Assignee: Cibus US LLC, San Diego, CA (US)

( * ) Notice: Subject to any disclaimer, the term of this patent is extended or adjusted under 35 U.S.C. 154(b) by 304 days.

(21) Appl. No.: 17/906,163

(22) PCT Filed: Jul. 7, 2022

(86) PCT No.: PCT/US2022/073508  
§ 371 (c)(1),  
(2) Date: Sep. 12, 2022

(87) PCT Pub. No.: WO2023/283597  
PCT Pub. Date: Jan. 12, 2023

(65) Prior Publication Data  
US 2024/0200043 A1     Jun. 20, 2024

Related U.S. Application Data

(60) Provisional application No. 63/219,291, filed on Jul. 7, 2021.

(51) Int. Cl.  
| *C12N 9/22* | (2006.01) |
| *C12N 15/62* | (2006.01) |
| *C12N 15/90* | (2006.01) |

(52) U.S. Cl.  
CPC .............. *C12N 9/22* (2013.01); *C12N 15/62* (2013.01); *C12N 15/902* (2013.01)

(58) Field of Classification Search  
None  
See application file for complete search history.

(56) References Cited

U.S. PATENT DOCUMENTS

| 8,440,431 B2 | 5/2013 | Voytas et al. |
| 2021/0010013 A1* | 1/2021 | Gocal ...................... C12N 9/22 |
| 2021/0277411 A1 | 9/2021 | Zhang et al. |

OTHER PUBLICATIONS

Truong et al. Nucleic acids Research (2015), vol. 43, No. 13, pp. 6450-6458.*  
Sun et al. J. Biol. Chem., (2004) 279:35281-35286).*  
Amitai et al. Proc. Natl Acad. Sci (2009), 106:11005-11010.*  
Shah et al. J. Am. Chem. Soc. (2013) 135:5839-5847.*  
Troung et al. Nucleic Acids Research (2015), 43(13):6450-6458.*  
Demorest et al. BMC Plant Biology (2016) 16:225.*  
Haun et al. Plant Biotechnology Journal (2014) 12: 934-940.*  
Li, "Split-inteins and their bioapplications", Biotechnol Lett, 37:2121-2137 (Jul. 8, 2015).  
Lienert et al., "Two- and three-input TALE-based and logic computation in embryonic stem cells", Nucleic Acids Research, 41(21):9967-9975 (Aug. 27, 2013). doi:10.1093/nar/gkt758.  
Schreiber et al., "Split-TALE: a TALE-Based Two-Component System for Synthetic Biology Applications in Planta", Plant Physiology, 179:1001-1012 (Mar. 2019).  
International Search Report and Written Opinion mailed Oct. 21, 2022 for corresponding International Patent Application PCT/US2022/073508.  
Perler et al., "Protein splicing elements: inteins and exteins—a definition of terms and recommended nomenclature", Nucleic Acids Research, 22(7):1125-1127, (Apr. 11, 1994).  
Xiong et al., "A transient expression system in soybean mesophyll protoplasts reveals the formation of cytoplasmic GmCRY1 photobody-like structures", Science China Life Sciences, 62(8):1070-1077, (Mar. 27, 2019). (Abstract).

* cited by examiner

*Primary Examiner* — Medina A Ibrahim  
(74) *Attorney, Agent, or Firm* — Dicke, Billig & Czaja, PLLC

(57) ABSTRACT

Embodiments of the present disclosure are directed to a plurality of nucleotide sequences encoding a first intein fused to at least a portion of a first transcription activator-like effector (TALE), a second nucleotide sequence encoding the first intein fused to at least a portion of a second TALE, and a third nucleotide sequence encoding a second intein fused to at least a portion of a rare-cutting nuclease.

20 Claims, 16 Drawing Sheets

Specification includes a Sequence Listing.

TRANSCRIPTION ACTIVATOR-LIKE EFFECTORS FUSED TO INTEINS

INCORPORATION-BY-REFERENCE OF MATERIAL SUBMITTED ELECTRONICALLY

Incorporated by reference in its entirety is a computer-readable nucleotide/amino acid sequence listing, an ASCII text file which is 115 kb in size, submitted concurrently herewith, and identified as follows: "C1633112111_SequenceListing" and created on Jul. 7, 2022.

CROSS-REFERENCE TO RELATED APPLICATIONS

This Utility Patent Application is a U.S. National Stage filing under 35 U.S.C. § 371 of PCT/US2022/073508, filed Jul. 7, 2022, which claims benefit to U.S. Provisional Patent Application No. 63/219,291, filed Jul. 7, 2021, which are each incorporated herein by reference in their entirety.

BACKGROUND

Genome editing technologies using rare-cutting nuclease, such as Transcription activator-like effector nucleases (TALEN), zinc finger nucleases (ZFNs), Clustered Regularly Interspaced Short Palindromic Repeats (CRISPR) and related CRISPR associated protein 9 (Cas9) or Cpf1 systems, have accelerated basic biology research, biotechnology, breeding, and gene therapy. The rare-cutting nucleases can be used to generate deletions, insertions, and initiate homologous recombination. TALENs include a rare-cutting nuclease and a TALE that can target a specific sequence and generate a precise break in deoxyribonucleic acid (DNA). One TALEN design includes a left-half TALEN that includes a left TALE fused to the rare-cutting nuclease that recognizes a first binding site followed by a spacer region and a right-half TALEN that includes a right TALE fused to the rare-cutting nuclease that recognizes a second binding site.

SUMMARY

The present disclosure is directed to overcoming the above-mentioned challenges and needs related to TALEs.

Various aspects are directed to a plurality of nucleotide sequences, comprising a first nucleotide sequence encoding a first intein fused to at least a portion of a first transcription activator-like effector (TALE), a second nucleotide sequence encoding the first intein fused to at least a portion of a second TALE, and a third nucleotide sequence encoding a second intein fused to at least a portion of a rare-cutting nuclease.

In some aspects, the first nucleotide sequence encodes the first intein fused to the first TALE and the second nucleotide sequence encodes the first intein fused to the second TALE. In some further aspects, the third nucleotide sequence encodes the second intein fused to the rare-cutting nuclease.

In some aspects, the first nucleotide sequence encodes the first intein fused to a first portion of the rare-cutting nuclease and the first TALE, and the second nucleotide sequence encodes the first intein fused to the first portion of the rare-cutting nuclease and the second TALE. In some further aspects, the third nucleotide sequence encodes the second intein fused to a second portion of the rare-cutting nuclease, wherein the first portion and the second portion of the rare-cutting nuclease form the rare-cutting nuclease.

In some aspects, the plurality of nucleotide sequences each include a separate vector and/or are on a single expression construct.

In some aspects, the first intein and the second intein are configured to self-splice when in contact and, in response, to form a first half transcription activator-like effector nuclease (TALEN) including the first TALE bound to the rare-cutting nuclease. In some further aspects, the first intein and the second intein are configured to self-splice when in contact and, in response, to form a second half TALEN including the second TALE bound to the rare-cutting nuclease.

In some aspects, the first intein and the second intein are configured to self-splice when in contact and to form a spliced protein including the first intein bound to the second intein.

In some aspects, each of the plurality of nucleotide sequences further encode a promoter and a terminator.

Some aspects are directed to a method comprising contacting a cell with: a first nucleotide sequence encoding a first intein fused to at least a portion of a first transcription activator-like effector (TALE), a second nucleotide sequence encoding the first intein fused to at least a portion of a second TALE, and a third nucleotide sequence encoding a second intein fused to at least a portion of a rare-cutting nuclease. The method further comprises, in response to contacting the cell, splicing the first TALE, the second TALE, and the rare-cutting nuclease by the first intein and the second intein to form: a first half transcription activator-like effector nuclease (TALEN) including the first TALE and the rare-cutting nuclease, and a second half TALEN including the second TALE and the rare-cutting nuclease.

In some aspects, the method further includes translating the first nucleotide sequence, the second nucleotide sequence, and the third nucleotide sequence to form the first intein fused to the first TALE, the first intein fused to the second TALE, and the second intein fused to the rare-cutting nuclease.

In some aspects, the method further includes transforming the cell using the first half TALEN and the second half TALEN.

In some aspects, the first nucleotide sequence encodes an N-terminal intein fused to a C-terminal of the first TALE, the second nucleotide sequence encodes the N-terminal intein fused to a C-terminal of the second TALE, and the third nucleotide sequence encodes a C-terminal intein fused to an N-terminal of the rare-cutting nuclease or the C-terminal intein fused between portions of the rare-cutting nuclease.

In some aspects, the first nucleotide sequence encodes a C-terminal intein fused to an N-terminal of the first TALE, the second nucleotide sequence encodes the C-terminal intein fused to an N-terminal of the second TALE, and the third nucleotide sequence encodes an N-terminal intein fused to a C-terminal of the rare-cutting nuclease or the N-terminal intein fused between portions of the rare-cutting nuclease.

In some aspects, splicing includes binding the first intein to the second intein to form: a first intermediate including the first intein bound to the second intein, wherein the first intein is fused to the first TALE and the second intein is fused to the rare-cutting nuclease, and a second intermediate including the first intein bound to the second intein, wherein the first intein is fused to the second TALE and the second intein is fused to the rare-cutting nuclease.

In some aspects, splicing includes: binding the first intein to the second intein, cutting splice sites associated with the first intein and the second intein, and binding the first TALE to the rare-cutting nuclease and binding the second TALE to the rare-cutting nuclease to form the first half TALEN and the second half TALEN.

In some aspects, the splice sites are between the first intein and the first TALE, the first intein and the second TALE, and the second intein and the rare-cutting nuclease or portions thereof.

Some aspects are directed to an expression construct, comprising: a first nucleotide sequence encoding a first intein fused to at least a first transcription activator-like effector (TALE), a second nucleotide sequence encoding the first intein fused to at least a second TALE, and a third nucleotide sequence encoding a second intein fused to at least a portion of a rare-cutting nuclease.

In some aspects, the first nucleotide sequence encodes an N-terminal intein fused to a C-terminal of the first TALE, the second nucleotide sequence encodes the N-terminal intein fused to a C-terminal of the second TALE, and the third nucleotide sequence encodes a C-terminal intein fused to an N-terminal of the rare-cutting nuclease or fused between portions of the rare-cutting nuclease.

In some aspects, the first nucleotide sequence encodes a C-terminal intein fused to an N-terminal of the first TALE, the second nucleotide sequence encodes the C-terminal intein fused to an N-terminal of the second TALE, and the third nucleotide sequence encodes an N-terminal intein fused to a C-terminal of the rare-cutting nuclease or fused between portions of the rare-cutting nuclease.

In some aspects, in response to translation of the first nucleotide sequence, the second nucleotide sequence, and the third nucleotide sequence by a cell, the first intein and second intein are configured to bind to one another and self-splice to form: a first half transcription activator-like effector nuclease (TALEN) including the first TALE bound to the rare-cutting nuclease, a second half TALEN including the second TALE bound to the rare-cutting nuclease, and a spliced protein including the first intein bound to the second intein.

In some aspects, the first nucleotide sequence, the second nucleotide sequence, and the third nucleotide sequence include separate vectors or are on a single expression construct.

In some aspects, the first TALE including a first plurality of TALE repeat sequences that, in combination, bind to a first nucleotide sequence in a target DNA sequence, and the second TALE including a second plurality of TALE repeat sequences that, in combination, bind to a second nucleotide sequence in the target DNA sequence.

In some aspects, each of the first nucleotide sequence, the second nucleotide sequence, and the third nucleotide sequence further encode a promoter and a terminator.

Various aspects are directed to a plant, plant part, or plant cells transformed by a plurality of nucleotide sequences, the plurality of nucleotide sequences, comprising: a first nucleotide sequence encoding a first intein fused to at least a portion of a first transcription activator-like effector (TALE), a second nucleotide sequence encoding the first intein fused to at least a portion of a second TALE, and a third nucleotide sequence encoding a second intein fused to at least portion of a rare-cutting nuclease. And, wherein the transformed plant, plant part, or plant cells express the first intein fused to the first TALE, the first intein fused to the second TALE, and the second intein fused to the rare-cutting nuclease.

In some aspects, the expressed first intein and second intein, of the first intein fused to the first TALE, the first intein fused to the second TALE, and the second intein fused to the rare-cutting nuclease, self-splice to form: a first half transcription activator-like effector nuclease (TALEN) including the first TALE bound to the rare-cutting nuclease, a second half TALEN including the second TALE bound to the rare-cutting nuclease, and a spliced protein including the first intein bound to the second intein.

In some aspects, the transformed plant, plant part, or plant cells exhibit: a first half transcription activator-like effector nuclease (TALEN) including the first TALE bound to the rare-cutting nuclease, a second half TALEN including the second TALE bound to the rare-cutting nuclease, and a spliced protein including the first intein bound to the second intein.

Various embodiments are directed to host cell and/or organism transformed by the methods, vectors, expression constructs, nucleotide sequences, and/or systems described herein.

Various embodiments are directed to a method of forming any of the nucleotide sequences and/or systems claimed herein.

BRIEF DESCRIPTION OF THE DRAWINGS

Various example embodiments can be more completely understood in consideration of the following detailed description in connection with the accompanying drawings, in which.

DETAILED DESCRIPTION

Figures 1A, 1B:
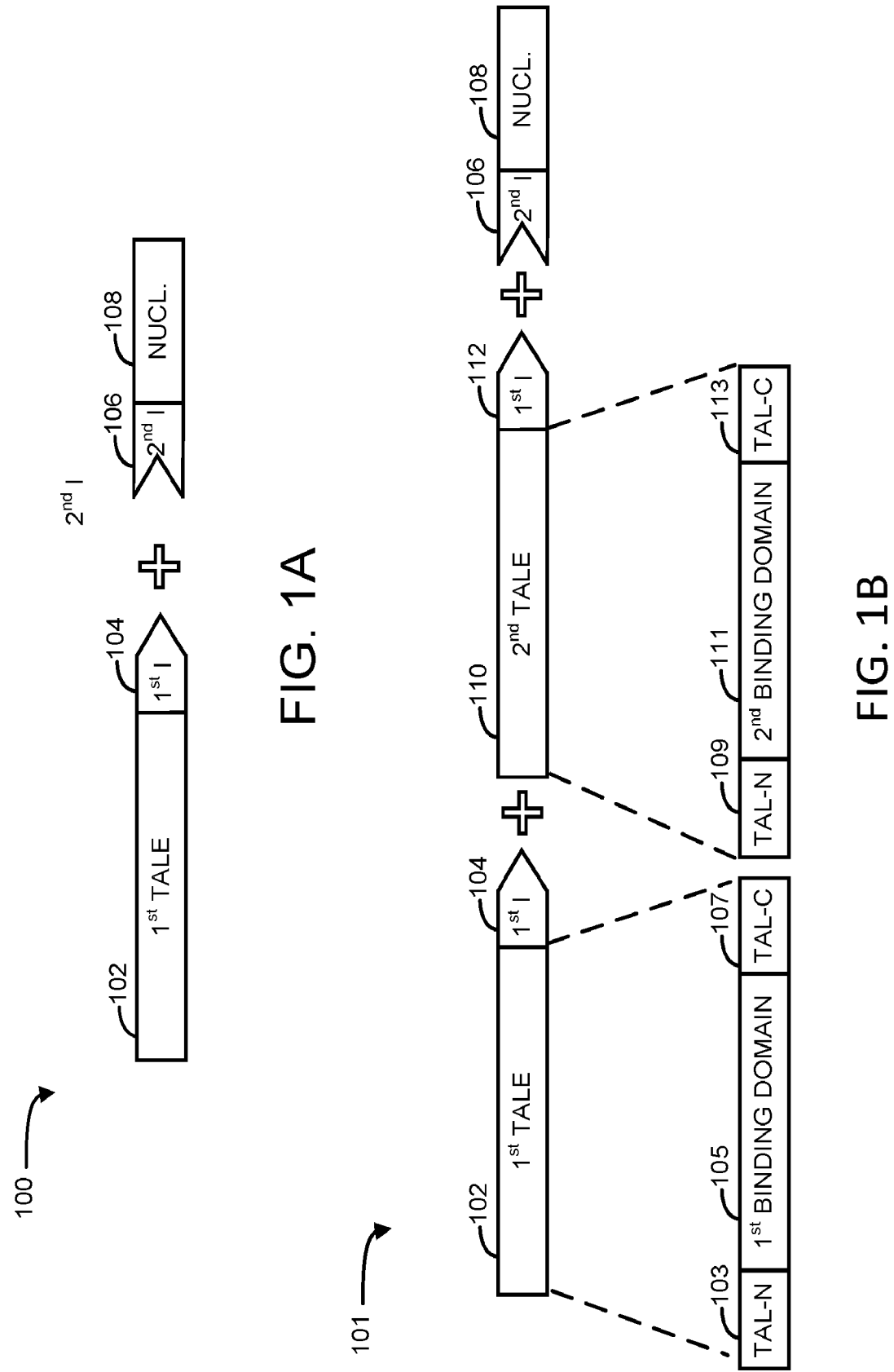
FIGS. 1A-1D are diagrams illustrating example nucleotide sequences that encode a first intein with a TALE and encode a second intein with a rare-cutting nuclease, consistent with the present disclosure.

Aspects of the present disclosure are directed to a variety of methods, nucleotide sequences, systems, expression constructs, and host cells and/or organisms transformed using the nucleotide sequences. While the present invention is not necessarily limited to such applications, various aspects of the invention may be appreciated through a discussion of various embodiments using this context.

Accordingly, in the following description various specific details are set forth to describe specific embodiments presented herein. It should be apparent to one skilled in the art, however, that one or more other examples and/or variations of these embodiments can be practiced without all the specific details given below. In other instances, well known features have not been described in detail so as not to obscure the description of the embodiments herein. For ease of illustration, the same reference numerals can be used in different diagrams to refer to the same elements or additional instances of the same element.

Rare-cutting nucleases, such as rare-cutting endonu- cleases, can be used to target specific genes or target multiple genes. Non-limiting examples include TALENs, engineered homing endonucleases, ZFNs, meganucleases, and CRISPR. Rare-cutting nucleases can be natural or engineered proteins having endonuclease activity directed to a nucleotide sequence with a recognition site, sometimes referred to as a target sequence, of 12-40 base pairs in length or longer. Typically, rare-cutting nucleases cause cleavage inside the recognitions site. In some instances, the rare- cutting nuclease is a fusion protein that contains a binding domain fused to a nuclease domain with cleavage activity. The binding domain can be configured to bind to a target sequence. The rare-cutting endonuclease domain can be configured to induce a mutation at a target genomic locus associated with the target location. TALENs and ZFNs are examples of fusion proteins of the binding domains with the nuclease domain, such as an endonuclease of FokI, some- times referred to as FokI. TALENs can be genetically engineered to have specificity to a target sequence via the binding domains fused to the nuclease domain, resulting in chimeric nucleases targeted to specific, selected DNA sequences, and leading to cutting of DNA at or near the target sequence. Such DNA cuts (double-stranded breaks) can induce mutations, such as knocking out or otherwise altering gene function with precision and efficiency.

Embodiments in accordance with the present disclosure are directed to use of inteins in nucleotide sequences con- taining TALEs and nucleases. In some embodiments, the half TALEs and nuclease are separate from one another, and the inteins can splice and ligate the respective half TALEs to the nuclease after translation. By using complementary inteins for the nucleotide sequences containing the half TALEs and the nucleases, the vectors delivered to and used to transform the cells of an organism can have a lower plasmid size, sometimes referred to as "cargo size", as compared to nucleotide sequences containing the full half TALENs. Decreased plasmid size can increase the expres- sion frequency of the nucleotide sequences. Additionally, use of inteins in nucleotide sequences containing TALEs and nucleases can add flexibility to delivery of gene editing material to the cell.

In some embodiments, the different nucleotide sequences can be delivered on a common expression construct, such as a plasmid. Although delivered together, each nucleotide sequence encodes a different molecular complex to be transcribed and translated separately from other molecular complexes. A molecular complex is a compound or complex of compounds transcribed and translated together to form a protein or fusion protein. For example, the first nucleotide sequence encodes a molecular complex of the first TALE fused to a first intein which are translated and transcribed together to form a fusion protein including the first TALE fused and the first intein. The resulting molecular complexes have a smaller cargo size as compared to translating and transcribing a nuclease fused to the first TALE. A fusion protein, as used herein, includes and/or refers to a protein or protein complex that includes at least two domains encoded by separate genes that are joined or fixed together such that the genes are transcribed and/or translated together as a single unit, producing a single polypeptide.

In any of the above described embodiments, the molecu- lar complexes are transcribed and translated, and then spliced to form TALENs to transform the cells. Decreased cargo size of the molecular complexes that are delivered inside a cell can increase the expression frequency of the transcribed forms of the molecular complexes. Additionally, use of inteins in the molecular complexes containing TALEs and nucleases can add flexibility to delivery of gene editing material to the cells. For example, the nucleotide sequence encoding the nuclease can remain the same, with only the variable portions of the TALEs being revised for different targets (e.g., in the first and second nucleotide sequences).

Turning now the figures, FIGS. 1A-1D are diagram illus- trating example nucleotide sequences that encode a first intein with a TALE and encode a second intein with a rare-cutting nuclease, consistent with the present disclosure.

As shown by FIG. 1A, the plurality of nucleotide sequences 100 encode the first intein 104 fused to at least a portion of the first TALE 102 and encode the second intein 106 fused to at least a portion of the rare-cutting nuclease 108. As further illustrated by FIG. 1B, the first TALE 102 can include a TALE N-terminal 103, a first plurality of TALE repeat sequences 105 (illustrated as a binding domain), and a TALE C-terminal 107. The first plurality of TALE repeat sequences 105 can, in combination, bind to a first nucleotide sequence in a target DNA sequence, and can be referred to as a binding domain. TALE repeat sequences can be an array of 33 to 35 amino acid-long repeats which differ at two positions (positions 12 and 13), sometimes referred to as "repeat variable diresidues (RVDs)". Each RVD recognizes a single nucleotide, and thus the array of multiple repeats identifies a unique nucleotide sequence of corresponding length to the number of repeats in the array, sometimes referred to as the "the target sequence.". The RVDs of the array together form the binding domain which binds to a target sequence.

As shown by FIG. 1B, another plurality of nucleotide sequences 101 can encode the first intein 104 fused to at least a portion of the first TALE 102, the second intein 106 fused to at least a portion of the rare-cutting nuclease 108, and a first intein 112 fused to at least a portion of a second TALE 110. The first inteins 104, 112 can include nucleotide sequences encoding the same intein (e.g., the intein sequence occurs twice). The second TALE 110 can include a TALE N-terminal 109, a second plurality of TALE repeat sequences 111 (illustrated as a binding domain), and a TALE C-terminal 113. The second plurality of TALE repeat sequences 111 can, in combination, bind to a second nucleo- tide sequence in a target DNA sequence, and can be referred to as a binding domain.

As shown by FIG. 1B, the plurality of nucleotide sequences 101 can include a first nucleotide sequence encoding the first intein 104 fused to the first TALE 102, a second nucleotide sequence encoding the first intein 112 fused to the second TALE 110, and a third nucleotide sequence encoding the second intein 106 fused to the rare-cutting nuclease 108. However, examples are not so limited and the first and/or second inteins can be fused to portions of the first TALE 102, second TALE 110, and/or rare-cutting nuclease 108, as further illustrated by FIG. 1C.

Figures 3A, 3B:
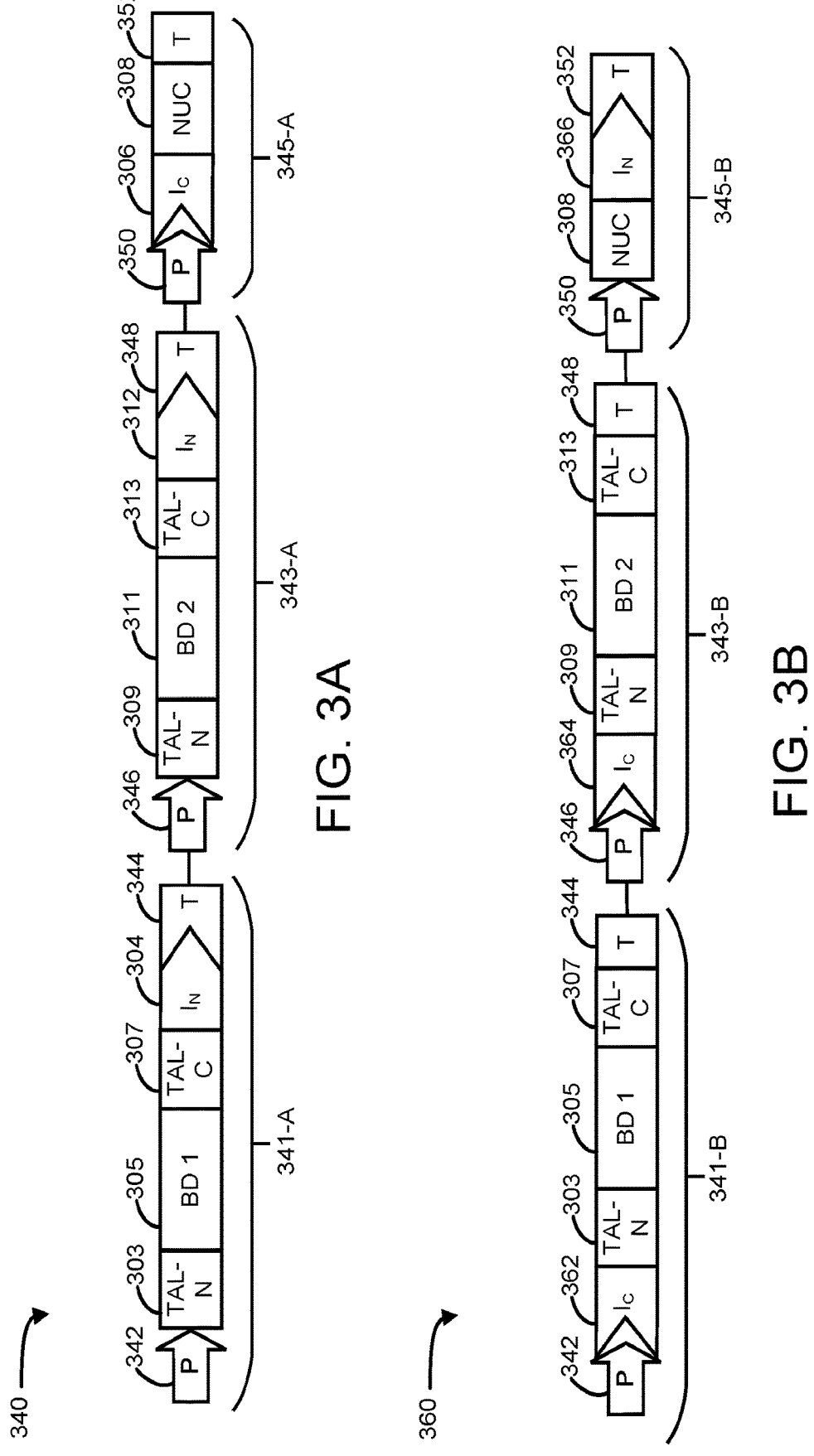
FIGS. 3A-3B are diagrams illustrating example expression constructs, consistent with the present disclosure.

In some embodiments, the plurality of nucleotide sequences 100, 101 can each form a separate vector. In some embodiments, the plurality of nucleotide sequences 100, 101 can be formed on a single expression construct, such as illustrated by FIGS. 3A-3B.

The first intein(s) 104, 112 and the second intein 106 can be configured to self-splice when in contact. In response to self-splicing, a first half TALEN can be formed including the first TALE 102 bound to the rare-cutting nuclease 108.

Further, a second half TALEN can be formed including the second TALE 110 bound to the rare-cutting nuclease 108. Additionally, a spliced protein including the first intein(s) 104, 112 bound to the second intein 106 can be formed. In some examples, the spliced protein is a trans-spliced protein. In some examples, the sliced protein is a cis-spliced protein.

As used herein, inteins are internal protein fragments or elements that self-excise from other protein(s) that the inteins are bound to and the inteins catalyze ligation of flanking components, sometimes referred to as exteins, with a peptide bond. Intein excision is a posttranslational process that may not require auxiliary enzymes or cofactors. This self-excision process is called "protein-splicing" by analogy to the splicing of RNA introns from pre-mRNA (Perler F et al., Nucl Acids Res. 22:1125-1127 (1994)). The first inteins 104, 112 and second intein 106 can respectively include an N-terminal intein and C-terminal intein having affinity for one another, and which bind together when in contact. The first inteins 104, 112 and second intein 106 can be referred to as trans-splicing inteins. With trans-splicing, one intein is an N-terminal intein (e.g., a fragment) which is bound to an N-extein and the other intein is a C-terminal intein which is bound to a C-extein. The N-terminal intein and C-terminal intein bind together, self-spice, and catalyze ligation of the N-extein and C-extein. In some examples, the intein sequences are derived from *Synechocystis* sp, *Saccharomyces cerevisiae, Pyrococcus horikoshii, Mycobacterium xenopi, Thermococcus kodakarensis, Methanocaldococcus jannaschii,* and *Nostoc punctiforme,* among others. Example inteins include Tfu pol-1 intein, DNA polymerase (DnaE) inteins (e.g., Ssp DnaE, Npu DnaE), Gp41-1, Mxe GyrA, Mru RecA, MTU RecA, Tli Pol-2, See VMA, and Ssp DNA helicase (Dna B), among others.

In some embodiments, the first and second inteins 104, 112, 106 can be orthogonal inteins. For example, an N-terminal intein from *Synechocystis* can bind to a C-terminal intein from *Nostoc,* and/or two different N-terminal inteins can bind to the same C-terminal intein.

Figures 1C, 1D:
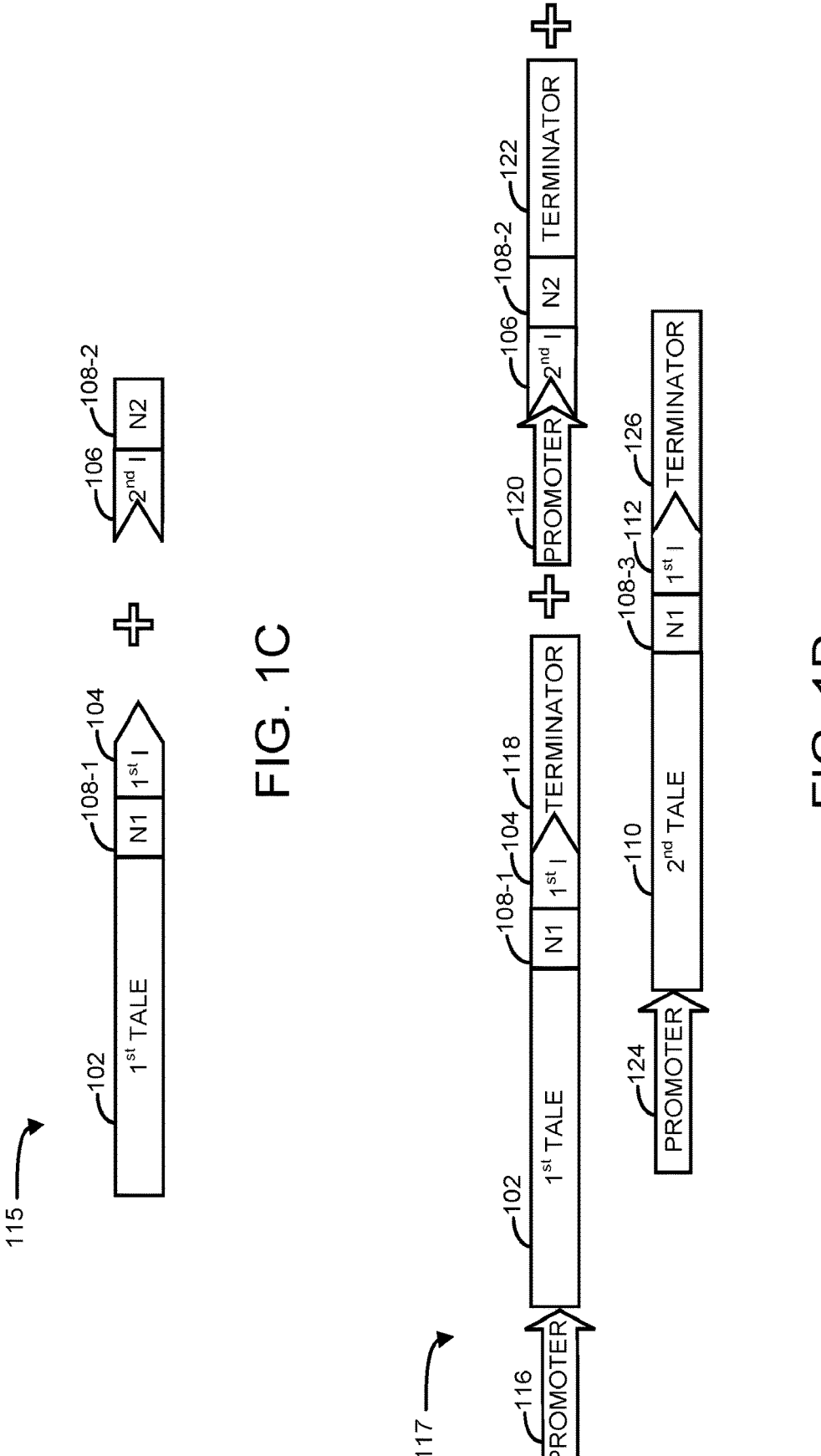

As further illustrated herein, such as by FIG. 1D, the plurality of nucleotide sequences 100, 101 can each further encode additional elements, such as a promoter and/or a terminator.

FIG. 1C illustrates an example of a plurality of nucleotide sequences 115 that encode an intein fused to a portion of the rare-cutting nuclease and a TALE. For example, the first nucleotide sequence encodes the first intein 104 fused to a first portion of the rare-cutting nuclease 108-1 fused to the first TALE 102. The second nucleotide sequence encodes the second intein 106 fused to a second portion of the rare-cutting nuclease 108-2. As shown, the first portion of the rare-cutting nuclease 108-1 is fused between the first TALE 102 and the first intein 104. Similar to the plurality of nucleotide sequences 100, 101, the first intein 104 and the second intein 106 can be configured to self-splice when in contact. In response to the splicing, the first and second portions of the rare-cutting nuclease 108-1, 108-2 can be bound together to form a first half TALEN with the first TALE 102. Although not illustrated by FIG. 1C, in some embodiments, a third nucleotide sequence can encode the first intein 104 fused to a first portion of the rare-cutting nuclease 108-1 fused to the second TALE, and, in response to the splicing, the first and second portions of the rare-cutting nuclease 108-1, 108-2 can be bound together to form a second half TALEN with the second TALE.

FIG. 1D illustrates an example of a plurality of nucleotide sequences 117 which each additionally include a promoter and a terminator. For example, the first nucleotide sequence encodes a first promoter 116, the first TALE 102, the first intein 104, a first terminator 118, and optionally, a portion of the rare-cutting nuclease 108-2. The second nucleotide sequence encodes a second promoter 124, the second TALE 110, the first intein 112, a second terminator 126, and optionally, a portion of the rare-cutting nuclease 108-3. The third nucleotide sequence encodes a third promoter 120, a second intein 106, at least a portion of the rare-cutting nuclease 108-2, and a third terminator 122. In some embodiments, the second intein 106 is fused to a second portion of the rare-cutting nuclease 108-2, and the first inteins 104, 112 are respectively fused to a first portion of the rare-cutting nuclease 108-1, 108-3 and the first TALE 102 or the second TALE 110.

However, embodiments are not so limited and in various embodiments, the first intein 104, 112 can be fused to a first portion of the first TALE 102 and/or a first portion of the second TALE 110, and/or the second intein 106 is fused to the second portion of the first TALE 102 and/or the second portion of the second TALE 110 which is fused to the rare-cutting nuclease as a single nucleotide sequence. In other embodiments, the second intein 106 is fused to the rare-cutting nuclease as a single nucleotide sequence.

As non-limiting examples, the promoters can include a nopaline synthase promoter (NosPro) or a T7 promoter, among others. Other example promoters can include Sp6 promoter, a T3 promoter, Ubi promoter, a cauliflower mosaic virus (CaMV) 35S promoter, an ADHI promoter, and ADH1 promoter, a GDS promoter, a TEF1 promoter, a Gall promoter, a CaMKlla promoter, a T7lac promoter, an ara-BAD promoter, a trp promoter, a lac promoter, a Ptac promoter, among others.

As non-limiting examples, the terminators can include Nos terminator (NosTerm), CaMV terminator, t7S, tE9, tmas, tocs, tTr9, tpinIII, tORF25, ttml, among others.

Figure 2:
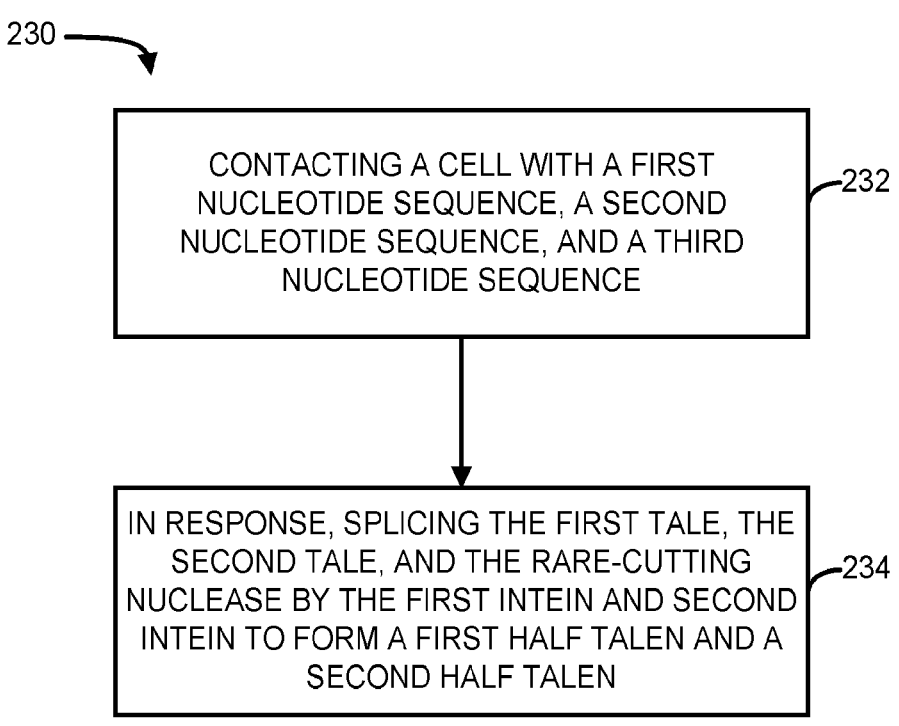
FIG. 2 is a flow diagram illustrating an example method for generating TALENs using example nucleotide sequences, consistent with the present disclosure.

FIG. 2 is a flow diagram illustrating an example method for generating TALENs using example nucleotide sequences, consistent with the present disclosure. The nucleotide sequences used in the method 230 can include the nucleotide sequences 100, 101, 115, 117 of any of FIGS. 1A-1D.

At 232, the method 230 includes contacting a cell with a first nucleotide sequence, a second nucleotide sequence, and a third nucleotide sequence. The first nucleotide sequence encodes a first intein fused to at least a portion of a first TALE. The second nucleotide sequence encodes the first intein fused to at least a portion of a second TALE. The third nucleotide sequence encodes a second intein fused to at least a portion of a rare-cutting nuclease.

At 234, in response to contacting the cell, the method 230 includes splicing the first TALE, the second TALE, and the rare-cutting nuclease by the first intein and the second intein to form a first half TALEN including the first TALE and the rare-cutting nuclease, and a second half TALEN including the second TALE and the rare-cutting nuclease. The first and second half TALENs can include left and right-half TALENs.

For example and in response to contacting the cell with the nucleotide sequences, the method 230 can include transcribing and/or translating the first nucleotide sequence, the second nucleotide sequence, and the third nucleotide sequence by the cell. In response to the transcription and/or translation, the first intein fused to the first TALE, the first intein fused to the second TALE, and the second intein fused to the rare-cutting nuclease can be formed or expressed. In various embodiments, a plurality of copies of each of the first nucleotide sequence, the second nucleotide sequence, and the third nucleotide sequence can be transcribed and/or translated, resulting in a plurality of copies of each of the first intein fused to the first TALE, the first intein fused to the second TALE, and the second intein fused to the rare-cutting nuclease.

The first intein and second intein can self-splice when in contact. The splicing process can result in intermediates being formed prior to forming the first and second half TALENs. For example, the first intein and the second intein can bind to form a first intermediate and a second intermediate, as further illustrated by FIG. 4. The first intermediate can include the first intein bound to the second intein, wherein the first intein is fused to the first TALE and the second intein fused to the rare-cutting nuclease. The second intermediate can include the first intein bound to the second intein, wherein the first intein is fused to the second TALE and the second intein is fused to the rare-cutting nuclease.

As described above, splicing includes binding between the inteins, cutting at splice sites, and binding between components. For example, splicing comprises binding the first intein to the second intern, cutting at splice sites associated with the first intein and the second intein, and binding the first TALE to the rare-cutting nuclease and the second TALE to the rare-cutting nuclease to form the first half TALEN and the second half TALEN. In some examples, splicing can include binding first and second portions of the rare-cutting nuclease to one another to form the full rare-cutting nuclease.

The splice sites can be between components of the plurality of nucleotide sequences. For example, splice sites can be between the first intein and the first TALE, between the first intein and the second TALE, and between the second intein and the rare-cutting nuclease or portions thereof. In some embodiments, splice sites can be between the second intein and each of the first and second portions of the rare-cutting nuclease.

In some embodiments, the method 230 can further include transforming the cell using the first half TALEN and the second half TALEN. For example, the first half TALEN and the second half TALEN can bind to a target DNA sequence via the binding domains and, in response, the endonucleases of the first half TALEN and the second half TALEN can cause a double stranded break in or near the target sequence.

Various embodiments are directed to systems that include the plurality of nucleotide sequences. In some embodiments, a single expression construct can include each of the plurality of nucleotide sequences. In other embodiments and/or in addition, each nucleotide sequence can form an individual vector.

FIGS. 3A-3B are diagrams illustrating example expression constructs, such as expression constructs including the nucleotide sequences illustrated by FIGS. 1A-ID, consistent with the present disclosure. Although FIGS. 3A-3B illustrate a single expression construct 340, 360, embodiments are not so limited and the respective nucleotide sequences can be on separate vectors forming system.

The system or expression construct 340, 360 comprise the above described first nucleotide sequence 341-A, 341-B, second nucleotide sequence 343-A, 343-B, and third nucleotide sequence 345-A, 345-B. The first nucleotide sequence 341-A, 341-B encodes a first intein 304, 362 fused to at least a portion of a first TALE 303, 305, 307. The first TALE 303, 305, 307 can include a TALE N-terminal 303, a first plurality of TALE repeat sequences, e.g., the first binding domain (BD1) 305, and a TALE C-terminal 307. The first plurality of TALE repeat sequences bind to a first nucleotide sequence in a target DNA sequence. The first nucleotide sequence 341-A, 341-B further includes a first promoter 342 and a first terminator 344. The first promoter 342 can be upstream of the first TALE 303, 305, 307 and the first intein 304, 362 and the first terminator 344 can be downstream of the first TALE 303, 305, 307 and the first intein 304, 362.

The second nucleotide sequence 343-A, 343-B encodes the first intein 312, 364 fused to at least a portion of a second TALE 309, 311, 313. The second TALE 309, 311, 313 can include a TALE N-terminal 309, a second plurality of TALE repeat sequences, e.g., the second binding domain (BD2) 311, and a TALE C-terminal 313. The second plurality of TALE repeat sequences bind to a second nucleotide sequence in the target DNA sequence. The second nucleotide sequence 343-A, 343-B further includes a second promoter 346 and a second terminator 348. The second promoter 346 can be upstream of the second TALE 309, 311, 313 and the first intein 312, 364 and the second terminator 348 can be downstream of the second TALE 309, 311, 313 and the first intein 312, 364.

The third nucleotide sequence 345-A, 345-B encodes a second intein 306, 366 fused to at least a portion of a rare-cutting nuclease 308. The third nucleotide sequence 345-A, 345-B further includes a third promoter 350 and a third terminator 352. The third promoter 350 can be upstream of the rare-cutting nuclease 308 and the second intein 306, 366 and the third terminator 352 can be downstream of the rare-cutting nuclease 308 and the second intein 306, 366.

As shown by the expression construct 340 of FIG. 3A, in some embodiments the first nucleotide sequence 341-A encodes an N-terminal intein 304 fused to a C-terminal 307 of the first TALE 303, 305, 307. The second nucleotide sequence 343-A encodes the N-terminal intein 312 fused to a C-terminal 313 of the second TALE 309, 311, 313. And, the third nucleotide sequence 345-A encodes a C-terminal intein 306 fused to an N-terminal of the rare-cutting nuclease 308 or fused between portions of the rare-cutting nuclease 308. In such embodiments, the first TALE 303, 305, 307 and second TALE 309, 311, 313 are respectively upstream from the first inteins 304, 312. The second intein 306 is upstream from at least a portion of the rare-cutting nuclease 308.

As shown by the expression construct 360 of FIG. 3B, in some embodiments the first nucleotide sequence 341-B encodes a C-terminal intein 362 fused to an N-terminal 303 of the first TALE 303, 305, 307. The second nucleotide sequence 343-B encodes the C-terminal intein 364 fused to an N-terminal 309 of the second TALE 309, 311, 313. And, the third nucleotide sequence 345-B encodes an N-terminal intein 366 fused to a C-terminal of the rare-cutting nuclease 308 or fused between portions of the rare-cutting nuclease 308. In such embodiments, the first TALE 303, 305, 307 and second TALE 309, 311, 313 are respectively downstream from the first inteins 362, 364. The second intein 366 is downstream from at least a portion of the rare-cutting nuclease 308.

As used herein, an expression construct includes and/or refers a nucleotide sequence (e.g., a nucleic acid sequence or DNA sequence) including one or more vectors or binary vectors carrying genome editing reagents. The genome editing reagents can include or encode a nuclease and/or a TALE. In some embodiments, the expression construct can include a variety of nucleotide sequences, selected and arranged to facilitate transport of genome editing reagents in the cells. For example, the expression construct can include the above-described first nucleotide sequence, second nucleotide sequence, and third nucleotide sequence. The rare-cutting nuclease can include a FokI protein, among other nucleases. In some embodiments, the expression construct and/or vectors can include other components, such as a detectable label, a promoter, and a terminator. The detectable label can include a fluorescent protein, a fluorophore, or nucleotide bound to a fluorophore, among other types of labels.

A vector or binary vector includes or refers to a nucleic acid sequence that includes one or more transgenes, sometimes referred to as "inserts", and a backbone. The binary vector can include an expression cassette that includes the transgene and a regulatory sequence to be expressed by a transformed cell.

As used herein, a domain includes and/or refers to a conserved part of a protein sequence and tertiary structure of the protein that can form a three-dimensional structure. The domains can be encoded by the expression constructs.

As further illustrated herein, in response to transcription and/or translation of the expression constructs 340, 360 respectively comprising the first nucleotide sequence 341-A, 341-B, the second nucleotide sequence 343-A, 343-B, and the third nucleotide sequence 345-A, 345-B, a plurality of copies of each of the first intein fused to the first TALE, the first intein fused to the second TALE, and the second intein fused to the rare-cutting nuclease can be formed. Further, respective inteins 304, 312, 306, 362, 364, 366 can bind to one another and self-splice to form first half TALENs and second half TALENS.

In some embodiments, the first promoter 342, the second promoter 346, and the third promoter 350 can include the same promoter. In other embodiments, the first promoter 342, the second promoter 346, and the third promoter 350 can each include different promoters. In further embodiments, the first promoter 342 and the second promoter 346 can be the same promoter, and the third promoter 350 can be a different promoter from the first promoter 342 and the second promoter 346. For example, the third promoter 350 can be a stronger promoter than the first promoter 342 and the second promoter 346, such that additional copies of the second intein fused to the rare-cutting nuclease are formed as compared to the number of copies of the first intein fused to the first TALE and the first intein fused to the second TALE after transcription and/or translation.

Figure 4:
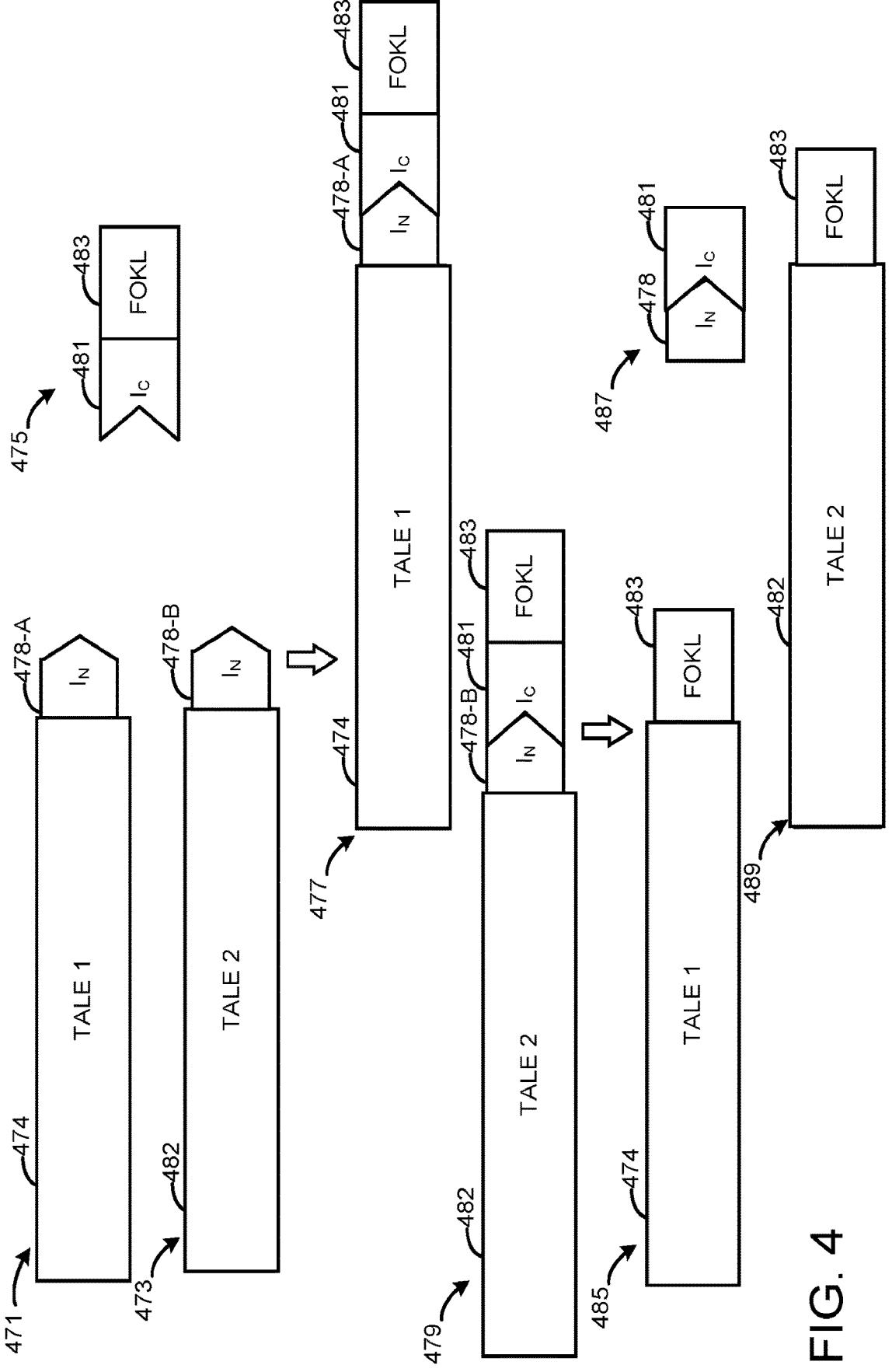
FIG. 4 is a flow diagram illustrating an example of splicing by inteins to form a TALEN, consistent with the present disclosure.

FIG. 4 is a flow diagram illustrating an example process of splicing by inteins to form TALENs, consistent with the present disclosure.

After contacting a population of cells with the plurality of nucleotide sequences, the plurality of nucleotide sequences are transcribed and/or translated by the cells to form the components 471, 473, and 475 including the first intein 478-A fused to the first TALE 474, the first intein 478-B fused to the second TALE 482, and the second intein 481 fused to the rare-cutting nuclease 483. Although a single copy of the components 471, 473, and 475 are illustrated by FIG. 4, a plurality of copies of each of the components 471, 473, and 475 can be formed.

The component 471, 473, and 475 can come in contact with one another, and in response, the first inteins 478-A, 478-B respectively bind to copies of the second intein 481. In response to the binding, a first intermediate 477 and a second intermediate 479 are formed. The first intermediate 477 includes the first intein 478-A bound to the second intein 481, wherein the first intein 478-A is fused to the first TALE 474 and the second intein 481 is fused to the rare-cutting nuclease 483. The second intermediate 479 includes the first intein 478-B bound to the second intein 481, wherein the first intein 478-B is fused to the second TALE 482 and the second intein 481 is fused to the rare-cutting nuclease 483.

After the first inteins 478-A, 478-B respectively bind to copies of the second intein 481, the inteins 478-A, 478-B, 481 self-splice to form a first half TALEN 485, a second half TALEN 489, and a spliced protein 487. For example, the inteins 478-A, 478-B, 481 can cut at splice sites associated with the first inteins 478-A, 478-B and the second intein 481, bind the first TALE 474 to the rare-cutting nuclease 483, and bind the second TALE 482 to the rare-cutting nuclease 483. The first half TALEN 485 can include the first TALE 474 bound to the rare-cutting nuclease 483 proximal to the C-terminal of the first TALE 474. The second half TALEN 489 can include the second TALE 482 bound to the rare-cutting nuclease 483 proximal to the C-terminal of the second TALE 482. The spliced protein 487 can include the first intein 478 (e.g., 478-A or 478-B) bound to the second intein 481. As used herein, a spliced protein includes and/or refers to a protein or protein complex that includes at least two domains encoded by separate genes that are transcribed and/or translated separately and that splice together to form a single unit, e.g., a single polypeptide As previously described, the first half TALEN 485 and the second half TALEN 489 can transform cells. For example, various embodiments are directed to a host cell and/or organism transformed by the methods, vectors, expression constructs, nucleotide sequences, and/or systems described herein. In some embodiments, the cells can be transformed and/or organism transformed or regenerated as described by U.S. Pat. No. 8,440,431, issued on May 14, 2013, entitled "TAL effector-mediated DNA medication", which is incorporated herein in its entirety for its teaching.

As used herein, contacting the population of cells with the plurality of nucleotide sequences can include delivering an expression construct into the population of cells. The expression construct can be delivered into the cells via different approaches including, but not limited to, PEG mediated transformation, Agrobacterium infection, electroporation, particle bombardment, or microinjection mediated protoplast transformation, as well as combinations thereof.

In various embodiments, prior to contacting a population of cells with the plurality of nucleotide sequences, such as an expression construct comprising the plurality of nucleotide sequences. The plurality of nucleotide sequences can be generated using standard molecular techniques.

In some examples, the population of cells can be screened to identify target cells that are genetically transformed by the plurality of nucleotide sequences and/or expression construct. Target cells, as used herein, include and/or refer to cells that express the plurality of nucleotide sequences and/or that otherwise exhibit or express the gene modification. The target cells can include the intended mutation at the target genomic locus. In some embodiments, the population of cells can be screened and target cells can be selected for expression of the expression construct via a detectable label. Screening the population of cells for the detectable label can include isolating target cells that have the detectable label from a remainder of the population of cells. Various embodiments include fluorescence activated cell sorting (FACS) based selection of transformed cells.

Accordingly, a number of embodiments are directed to the combination of DNA-mediated gene editing of cells, along with the selection of target cells receiving both half TALENs using FACS and fluorescent proteins or fluorophore labelling of the two TALENs. Organisms regenerated from FACS selected cells can be enriched for the intended gene edits, thus reducing the screening efforts typically required with transient gene expression.

Various embodiments of the present disclosure are directed to a non-naturally occurring host cell and/or organisms generated by the method 230 described by FIG. 2 and/or using the plurality of nucleotide sequences or components illustrated by FIGS. 1A-1D, 3A-3B, and 4. For example, the method 230 can further include culturing the identified target cells that are transformed with the plurality of nucleotide sequences, and regenerating an organism from the cultured target cells, where the regenerated organisms express the target modification. The plurality of nucleotide sequences and/or resulting components (e.g., half TALENs and spliced proteins) can be removed (e.g., crossed away) from the regenerated organism.

In some embodiments and consistent with method 230, a non-naturally occurring organism can be generated by a genomic editing technique that includes using the plurality of nucleotide sequences. The plurality of nucleotide sequences can be separate vectors and/or formed on a single expression construct. The genomic editing technique can include contacting a population of cells with the plurality of nucleotide sequences, screening the population of cells to identify target cells that are transformed with the plurality of nucleotide sequences, and, optionally, regenerating a non-naturally occurring organism from the identified target cells.

The cell and/or cell population, as used herein, can be from a variety of different types of organisms. Examples cells can be from mammals, birds, reptiles, amphibians, fish, insects, crustaceans, arachnids, echinoderms, worms, mollusks, sponges, plants, fungi, algae, bacteria, among others.

As used herein, upstream can include a location proximal to and/or closer to the 5' end of the nucleotide sequence as compared to the referenced sequence. Conversely, downstream can include a location proximal to and/or closer to the 3' end of the nucleotide sequence as compared to the referenced sequence. As used herein, a sequence with adjectives listed in front, such as the rare-cutting nuclease sequence, intein sequence, or TALE sequence, includes or refers to a nucleotide sequence that encodes or is the adjectives (e.g., encodes or is the nuclease).

Different example approaches for enriching and/or screening the cells for the intended gene edit(s) are now described. Enriching and/or screening the cells can increase the representation of cells likely to contain the intended genomic edit.

The plurality of nucleotide sequence can be delivered into cells or other tissues using a variety of known methods such as PEG-mediated transformation, electroporation, bombardment, or microinjection mediated transformation. For larger tissues with cell walls such as embryos, bombardment (or biolistics) with gold particles coated with DNA can be used as delivery methods. Following delivery of the nucleotide sequences, FACS can be used to select fluorescent colored positive cells.

For particle bombardment transformation, the expression constructs can be coated onto particles, such as gold particles. To coat the nucleic acid on the gold particles, different volumes of nucleic acid solution are mixed with a fixed amount of gold suspension by pipetting.

Although embodiments are not so limited, and various particle bombardment transformation protocols can be used.

For convenience, certain terms employed in the specification, examples, and appended claims are provided here. The definitions are provided to aid in describing particular embodiments and are not intended to limit the claimed invention, as the scope of the invention is limited only by the claims.

The use of the term "or" in the claims and specification is used to mean "and/or" unless explicitly indicated to refer to alternatives only or the alternatives are mutually exclusive, although the disclosure supports a definition that refers to only alternatives and "and/or."

Unless the context clearly requires otherwise, throughout the description and the claims, the words "include", "including", "comprise," "comprising," and the like, are to be construed in an open and inclusive sense as opposed to a closed, exclusive or exhaustive sense. For example, the term "comprising" can be read to indicate "including, but not limited to." Words using the singular or plural number also include the plural and singular number, respectively. The words "a" and "an," when used in conjunction with the word "comprising" or "including" in the claims or specification, denotes one or more, unless specifically noted.

As used herein, the term "polypeptide" or "protein" includes and/or refers to a polymer in which the monomers are amino acid residues that are joined together through amide bonds. When the amino acids are alpha-amino acids, either the L-optical isomer or the D-optical isomer can be used, the L isomers being typical. The term polypeptide or protein as used herein encompasses any amino acid sequence and includes modified sequences, such as glycoproteins. The term polypeptide, unless noted otherwise, is specifically intended to cover naturally occurring proteins, as well as those that are recombinantly or synthetically produced.

The term "nucleotide sequence" includes and/or refers to a plurality of nucleotides in a chain or a sequence. A nucleotide includes and/or refers to a compound including a nucleoside (e.g., a nucleobase with a carbon sugar) linked to a phosphate group. The nucleotide sequence may sometimes be referred to as nucleic acid, with the nucleotides of the sequence forming the building blocks of nucleic acid. The term "nucleic acid" includes and/or refers to DNA or RNA nucleic acid and sequences of nucleic acids in either single or doublestranded form, and unless otherwise limited, encompasses known analogs of natural nucleotides that hybridize to nucleic acids in manner similar to naturally occurring nucleotides. Unless otherwise indicated, a particular nucleotide sequence or nucleic acid sequence includes the complementary sequence thereof.

Disclosed are materials, compositions, and components that can be used for, can be used in conjunction with, can be used in preparation for, or are products of the disclosed methods and compositions. It is understood that, when combinations, subsets, interactions, groups, etc., of these materials are disclosed, each of various individual and collective combinations is specifically contemplated, even though specific reference to each and every single combination and permutation of these compounds may not be explicitly disclosed. This concept applies to all aspects of this disclosure including, but not limited to, steps in the described methods. Specific elements of any foregoing embodiments can be combined or substituted for elements in other embodiments. For example, if there are a variety of additional steps that can be performed, each of these additional steps can be performed with any specific method step or combination of method steps of the disclosed methods, and each such combination or subset of combinations is specifically contemplated and disclosed. Additionally, it is understood that the embodiments described herein can be implemented using any suitable material such as those described elsewhere herein or as known in the art.

Various embodiments are implemented in accordance with the underlying provisional application, U.S. Provisional Application No. 63/219,291, filed on Jul. 7, 2021, and constructs and sequences used to experimental embodiments include the nucleotide sequences set forth in SEQ ID NOs: 1-159. SEQ ID NOs: 1-164 are each synthetic DNA.

The different vectors are shown below in Table 1. The nucleic acid vectors in Table 1 include DNA constructs.

TABLE 1

| Name | Composition | Description |
|---|---|---|
| Plasmid Vector 1 | NosPro-TALE-BnFAD2 (T03-L)-Ssp DnaE int-N-NosTerm | Left TAL effector with BnFAD2 DNA binding domain fused to an Ssp DnaE int-N sequence |
| Plasmid Vector 9 | NosPro-TALE-BnFAD2 (T03-R)-Ssp DnaE int-N-NosTerm | Right TAL effector with BnFAD2 DNA binding domain fused to an Ssp DnaE int-N sequence |
| Plasmid Vector 13 | NosPro-TALE-Ssp DnaE int-N-NosTerm | Left TAL effector fused to an Ssp DnaE int-N sequence, includes BsaI sites for GG TALE cloning |
| Plasmid Vector 15 | NosPro-TALE-Ssp DnaE int-N-NosTerm | Right TAL effector fused to an Ssp DnaE int-N sequence, includes BsaI sites for GG TALE cloning |
| Plasmid Vector 17 | NosPro- Ssp DnaE int-C-FokI-NosTerm | FokI endonuclease fused to an Ssp DnaE int-C peptide sequence |
| Plasmid Vector Control 1 | NosPro-TALE-BnFAD2 (T03-L)-N-NosTerm | Control LHT with BnFAD2 DNA binding domain |
| Plasmid Vector Control 2 | NosPro-TALE-BnFAD2 (T03-R)-N-NosTerm | Control RHT with BnFAD2 DNA binding domain | entitled "Transcription Activator-Like Effectors Fused to Inteins"; to which benefit is claimed and is fully incorporated herein by reference. For instance, embodiments herein and/or in the provisional application can be combined in varying degrees (including wholly). Embodiments discussed in the provisional applications are not intended, in any way, to be limiting to the overall technical disclosure, or to any part of the claimed invention unless specifically noted.

While illustrative embodiments have been illustrated and described, it will be appreciated that various changes can be made therein without departing from the scope of the invention.

EXPERIMENTAL EMBODIMENTS

Various experimental embodiments were directed to designing different nucleic acid vectors, sometimes herein referred to as vectors for ease of reference and which can include the previously described expression constructs or a portion thereof, such as a DNA or mRNA construct. The vectors encode a first intein fused to at least a portion of a first TALE, the first intein fused to at least a portion of a second TALE, and a second intein fused to at least a portion of a rare-cutting nuclease. Specific experiments were designed to show genetic editing by the above-described vectors. A number of experiments conducted are described herein.

In various experimental embodiments, several vectors were designed and constructed. The vectors included a TAL effector fused to an Ssp DnaE int-N peptide sequence, and an endonuclease fused to an Ssp DnaE int-C peptide sequence. Together, the Ssp DnaE int-N and int-C peptide sequences make up a trans intein, referred to here as intein. Specific experiments were conducted to show genetic editing from joint activity of these intein vectors. Example The constructs in Table 1 were generated in the experimental embodiments are described in detail below. The plasmid vectors 1 and 9 encode a TAL effector that targets the gene BnFAD2 fused to an Ssp DnaE int-N peptide sequence. Plasmid vector 1 (SEQ ID NO: 1) encodes a promoter NosPro, a TAL effector targeting the gene BnFAD2, an Ssp DnaE int-N peptide sequence, a terminator NosTerm, and a left half TALEN (HT) backbone. The plasmid vector 9 (SEQ ID NO: 9) encodes a promoter NosPro, a TAL effector targeting the gene BnFAD2, an Ssp DnaE int-N peptide sequence, a terminator NosTerm, and a right HT backbone. Plasmid vector 17 (SEQ ID NO: 17) encodes an Ssp DnaE int-C peptide sequence fused to the FokI endonuclease. Plasmid vector 17 encodes a promoter NosPro, an Ssp DnaE int-C peptide sequence, a FokI endonuclease, and a terminator NosTerm. In the experimental embodiments, plasmid vectors 1, 9, and 17 were jointly used to demonstrate TALEN gene editing activity.

A sequence of plasmid vector 1 is set forth in SEQ ID NO: 1, which encodes a Nos promoter (SEQ ID NO: 2), left TALE N-terminal (SEQ ID NO: 3), BnFAD2 (T03-L) binding domain (SEQ ID NO: 4), left TALE C-terminal (SEQ ID NO: 5), a linker (SEQ ID NO: 6), Ssp DnaE int-N(SEQ ID NO: 7), and a Nos terminator (SEQ ID NO: 8). A sequence of plasmid vector 9 is set forth in SEQ ID NO: 9, which encodes a Nos promoter (SEQ ID NO: 2), right TALE N-terminal (SEQ ID NO: 10), BnFAD2 (T03-R) binding domain (SEQ ID NO: 11), right TALE C-terminal (SEQ ID NO: 12), a linker (SEQ ID NO: 6), Ssp DnaE int-N(SEQ ID NO: 7), and a Nos terminator (SEQ ID NO: 8). A sequence of plasmid vector 17 is set forth in SEQ ID NO: 17, which encodes a Nos promoter (SEQ ID NO: 2), Ssp DnaE int-C(SEQ ID NO: 18), a linker (AGCCGTTCC), FokI (SEQ ID NO: 19), and a Nos terminator (SEQ ID NO: 8).

Gene editing activity of the plasmid vectors 1, 9, and 17 were compared against plasmid vectors control 1 and control 2. Plasmid vector control 1 consists of a promoter NosPro, a TALEN targeting BnFAD2 (T03-L), and a terminator NosTerm in a left HT backbone. Plasmid vector control 2 consists of a promoter NosPro, a TALEN targeting BnFAD2 (T03-R), and a terminator NosTerm in a right HT backbone.

The promoter NosPro and the terminator NosTerm are based on sequences from *Agrobacterium tumefaciens*, the TAL effector is based off a *Xanthomonas* sequence, the BnFAD2 (T03) targets a sequence found in *Brassica napus*, the FokI endonuclease is based off a *Flavobacterium okeanokoites* sequence, and the Ssp DnaE int-C and int-N peptide sequences are from *Synechocystis* sp. PCC6803.

The remaining example constructs of Table 1 are described below. Plasmid vector 13 (set forth in SEQ ID NO: 13) and plasmid vector 15 (set forth in SEQ ID NO: 15) are entry vectors that encode a TAL effector fused to an Ssp DnaE int-N peptide sequence. Plasmid vector 13 encodes a promoter NosPro, a TAL effector, a lacZ cassette flanked by BsaI sites for Golden Gate cloning, an Ssp DnaE int-N sequence, and terminator NosTerm in a left HT backbone. Plasmid vector 15 encodes a promoter NosPro, a TAL effector, a lacZ cassette flanked by BsaI sites for Golden Gate cloning, an Ssp DnaE int-N sequence, and terminator NosTerm in a right HT backbone.

A sequence of plasmid vector 13 is set forth in SEQ ID NO: 13, which encodes a Nos promoter (SEQ ID NO: 2), left TALE N-terminal (SEQ ID NO: 3), LacZ cassette (SEQ ID NO: 14), left TALE C-terminal (SEQ ID NO: 5), a linker (SEQ ID NO: 6), Ssp DnaE int-N(SEQ ID NO: 7), and a Nos terminator (SEQ ID NO: 8). A sequence of plasmid vector 15 is set forth in SEQ ID NO: 15, which encodes a Nos promoter (SEQ ID NO: 2), right TALE N-terminal (SEQ ID NO: 10), LacZ cassette (SEQ ID NO: 16), right TALE c-terminus (SEQ ID NO: 12), a linker (SEQ ID NO: 6), Ssp DnaE int-N(SEQ ID NO: 7), and a Nos terminator (SEQ ID NO: 8).

Additional experiments were conducted to illustrate transformation of cells with the vectors of Table 1, as shown by Table 2. More specifically, canola protoplasts were transformed using the vectors illustrated in Table 1. These include the previously described vectors SEQ ID NO: 1, SEQ ID NO: 9, SEQ ID NO: 17, plasmid vector control 1, and plasmid vector control 2. All samples were used to transform 200,000 protoplasts each, and all samples were tested as biological replicates. Samples A and D included 30 ug each of a process control plasmid, which functioned as a negative control during data analysis. Samples B and E included 30 ug each of control vectors for the genetic editing of target BnFAD2 (T03), plasmid vector control 1, and plasmid vector control. Samples C and F included 30 ug of the three intein plasmids SEQ ID NO: 1, SEQ ID NO: 9, and SEQ ID NO: 17. The intein samples C and F were compared to the positive control samples B and E to assess gene editing efficiency. All samples were prepared using the same Illumina sequence for analysis. The vectors were used to transform canola protoplasts to compare the gene editing efficiency of the intein TALEN vectors to the TALEN vectors without the intein peptide sequences. Table 2 illustrates the experiments conducted.

TABLE 2

| Sample | A | B | C | D | E | F |
|---|---|---|---|---|---|---|
| Plasmid 1 | Negative control | Plasmid Vector control 1 | Plasmid Vector 1 | Negative control | Plasmid Vector control 1 | Plasmid Vector 1 |
| Description | pVaUbi3_YFP_NosTerm (negative control) | NosPro-TALE-BnFAD2 (T03-L)-N-NosTerm | NosPro-TALE-BnFAD2 (T03-L)-Ssp DnaE int-N-NosTerm | pVaUbi3_YFP_NosTerm (negative control) | NosPro-TALE-BnFAD2 (T03-L)-N-NosTerm | NosPro-TALE-BnFAD2 (T03-L)-Ssp DnaE int-N-NosTerm |
| Type | DNA | DNA | DNA | DNA | DNA | DNA |
| Per 100k cells (ug) | 15 | 15 | 15 | 15 | 15 | 15 |
| Total Quantity (ug) | 30 | 30 | 30 | 30 | 30 | 30 |
| Conc. (ug/ul) | 2.604 | 1.691 | 5.2 | 0.300 | 0.300 | 0.300 |
| Vol. (ul) | 11.52 | 17.74 | 5.77 | 100.00 | 100.00 | 100.00 |
| Protoplast # | 200K | 200K | 200K | 200K | 200K | 200K |
| Plasmid 2 | | Plasmid Vector control 2 | Plasmid Vector 9 | | Plasmid Vector control 2 | Plasmid Vector 9 |
| Description | | NosPro-TALE-BnFAD2 (T03-R)-N-NosTerm | NosPro-TALE-BnFAD2 (T03-R)-Ssp DnaE int-N-NosTerm | | NosPro-TALE-BnFAD2 (T03-R)-N-NosTerm | NosPro-TALE-BnFAD2 (T03-R)-Ssp DnaE int-N-NosTerm |
| Type | | DNA | DNA | | DNA | DNA |
| Per 100k cells (ug) | | 15 | 15 | | 15 | 15 |
| Total Quantity (ug) | | 30 | 30 | | 30 | 30 |

TABLE 2-continued

| Sample | A | B | C | D | E | F |
|---|---|---|---|---|---|---|
| Conc. (ug/ul) | | 1.838 | 6.3 | | 0.300 | 0.300 |
| Vol. (ul) | | 16.32 | 4.76 | | 100.00 | 100.00 |
| Plasmid 3 Description | | | Plasmid Vector 17 | | | Plasmid Vector 17 |
| Type | | | DNA | | | DNA |
| Per 100k cells (ug) | | | 15 | | | 15 |
| Total Quantity (ug) | | | 30 | | | 30 |
| Conc. (ug/ul) | | | 3.1 | | | 0.300 |
| Vol. (ul) | | | 9.68 | | | 100.00 |
| Note | Negative control | TALEN positive control | Intein TALEN sample | Negative control | TALEN positive control | Intein TALEN sample |

To perform the canola transformation, 30-60 days before the experiment, 10 canola seeds were washed with 1.5 mL 70% ethanol, and then 1.8 mL of sterile water. To sterilize the seeds, 1.5 mL of a 1% sodium hypochlorite solution was used to wash the seeds, and then the seeds were washed an additional five times with 1.8 mL sterile water. After imbibing, six of the newly sterilized seeds were planted on 8P-MS-G media in a PlantCon. The seeds were incubated at 25 C in a 16/8 hr light/dark ratio.

After 30-60 days of incubation, the germinated canola plantlets were digested. Sterile scissors were used to excise 4-6 young canola leaves and the leaves were placed into a petri plate containing 50-100 ul CPDS. The leaves were chopped into 0.5-1 mm pieces using a sterile, straight edge razor. Another 4 mL of CPDS was added to the plate, and the plate was placed inside a larger 100 mm petri plate to ensure sterility. The plates were moved to a vacuum chamber and vacuum at 30 inHg for 10 minutes. After 10 minutes, the plate was incubated at 25 rpm for 16 hours in the dark at 25 C.

After 16 hours, the protoplast digestion was washed with 4 mL of W-5 plus Carb100 solution, and the protoplast solution was gently pipetted through a Falcon 40 um cell strainer into a 50 mL tube. This step was repeated once more. The tube was then centrifuged for 5 minutes at 100×g. After centrifugation, the supernatant was discarded and the pellet was resuspended with 4 mL of W-5 wash buffer, centrifuged one more time, and remaining supernatant was discarded. The washed pellet was then resuspended with 2 mL W-5 wash buffer, and 20 ul of the suspension was loaded onto a hemocytometer for cell counting. Cell counts among four grids of the hemocytometer were used to get an average number of protoplasts per grid. The total number of protoplasts in the sample was calculated as follows: (($\bar{x}${a,b,c,d})/0.2)×1000×2 (mL)=total # of protoplasts, where x is the average of the four grids {a,b,c,d} that were counted previously. To perform the transformation, the 50 mL tube containing the 2 mL of W-5 buffer and protoplast suspension was centrifuged for 5 minutes at 100×g. For samples A-C, the supernatant was removed and 1 mL of room temperature 1×MMG per $1\times10^6$ protoplasts was added, and a volume corresponding to 200,000 protoplasts was added to a 1.5 mL microcentrifuge tube containing the specified amount of vectors for each transformation. For samples D-F, 500 ul of room temperature 2×MMG per $1\times10^6$ protoplasts was added along with the specified amount of DNA vectors to the 200,000 protoplasts in a 1.5 mL microcentrifuge tube. For all samples, the protoplast suspension was mixed with the vectors by slowing pipetting the liquid up and down. The protoplasts and plasmid vectors were incubated at room temperature for 5 minutes. After 5 minutes, a 1× volume of room temperature PEG was added to each microcentrifuge tube, and pipetted up and down until thoroughly mixed. The tubes were then incubated at room temperature for 20 minutes. After 20 minutes, 1.5 mL of W-5 wash buffer was added to resuspend the protoplasts. The tubes were centrifuged at 200×g for 5 minutes, the supernatant was removed, and an additional 800 ul of W-5 wash buffer was added to resuspend the cells. 0.5-2 mL of the washed protoplasts were transferred to a 6-24 well plate and incubated for 24-48 hours.

To assess gene editing activity, the protoplasts were harvested by transferring the protoplasts to a 1.5 mL microcentrifuge tube. The suspension was centrifuged at 200×g for 5 minutes, the supernatant was discarded, and the tubes were placed in liquid nitrogen for two minutes. The tubes were then stored at –80 C until the protoplast DNA was extracted and analyzed by Illumina.

Table 3 illustrates detected deletions from the protoplasts transformed with the vectors described in Table 1. The gene editing efficiencies, shown here as percent events, were compared across the samples A-F. Samples A and D included canola protoplasts transformed with vectors expressing YFP and served as a negative control, where no editing was expected. Samples B and E included canola protoplasts transformed with TALENs targeting the gene BnFAD2. Samples C and F included canola protoplasts transformed with TAL effectors and a FokI endonuclease, each fused to an Ssp DnaE int-N or int-C sequence, also targeting BnFAD2.

Table 3 shows the results of an NHEJ mutation assay that detects the number of deletions, or events, in the population of protoplast cells that were transformed with the above vectors. The assay amplifies three genomic regions containing the target BnFAD2, represented in Table 3 as Illumina 1, 2, and 3. As shown, the TALEN intein samples produced a significantly higher number of deletions than the YFP negative control, although they did not produce deletions at the same frequency of the TALEN control vectors.

TABLE 3

| Sample | Biological Replicate | Sample description | Percent events (avg. across Illumina copies 1-3) |
|---|---|---|---|
| A | 1 | pVaUbi3_YFP_NosTerm negative control | 0.006074698 |
| A | 2 | pVaUbi3_YFP_NosTerm negative control | 0.007731365 |
| B | 1 | TALEN positive control | 2.460016807 |
| B | 2 | TALEN positive control | 2.114974022 |
| C | 1 | Intein TALEN sample | 0.208803999 |
| C | 2 | Intein TALEN sample | 0.42680571 |
| D | 1 | pVaUbi3_YFP_NosTerm negative control | 0.004661722 |
| D | 2 | pVaUbi3_YFP_NosTerm negative control | 0.011750975 |
| E | 1 | TALEN positive control | 4.474206527 |
| E | 2 | TALEN positive control | 5.84799401 |
| F | 1 | Intein TALEN sample | 0.130803747 |
| F | 2 | Intein TALEN sample | 0.223925849 |

The experiments tested the use of trans-splicing inteins as a method to reduce plasmid cargo size of the TALEN vectors, and also add flexibility when delivering gene editing materials to the cell. As previously described, the experiments were performed in Canola (Bn-Westar) protoplast. The target with TALEN T03.01 in the FAD2 gene, which has three known copies. The protoplasts were genotyped using amplicon sequencing to detect edits in the three FAD2 gene copies. Table 4 below provides a summary of the resulting sequence coverage.

For the experiments, there was good coverage across all three gene copies for each intein sample (e.g., average of greater than 28,000 reads, with a range of between 24,000 and 41,000 reads). Experiments 1 and 2 were performed to test different concentrations of transformation inputs. Specifically, experiment 2 (the "Mod" method) used a higher volume of DNA at a lower concentration.

Table 4 and Table 5 below provide the percent editing for experiments 1 and 2. In both experiments, the intein samples consistently showed some level of editing higher than the negative controls, but lower than the positive controls. Experiment 2 (Mod method, lower amount of DNA) have higher percent editing in the positive control, but lower in the intein samples. As may be appreciated, percent editing= (number of reads with edits/total number of reads analyzed) *100.

TABLE 4

| | Experiment 1 Percent Editing | | | | | |
|---|---|---|---|---|---|---|
| | Sample A: YFP (−) control | Sample A: YFP (−) control | Sample B: (+) BnFAD2 (T03) | Sample B: (+) BnFAD2 (T03) | Sample C: Inteins | Sample C: Inteins |
| BnaA.FAD2.a | 0.007 | 0.003 | 2.568 | 2.110 | 0.265 | 0.504 |
| BnaC.FAD2.a | 0.009 | 0.006 | 2.687 | 2.228 | 0.237 | 0.548 |
| BnaC.FAD2.b | 0.003 | 0.014 | 2.125 | 2.007 | 0.125 | 0.228 |
| Avg. | 0.006 | 0.008 | 2.460 | 2.115 | 0.209 | 0.427 |

TABLE 5

| | Experiment 2 Percent Editing | | | | | |
|---|---|---|---|---|---|---|
| | Sample D: YFP (−) control | Sample D: YFP (−) control | Sample E: (+) BnFAD2 (T03) | Sample E: (+) BnFAD2 (T03) | Sample F: Inteins | Sample F: Inteins |
| BnaA.FAD2.a | 0.004 | 0.010 | 4.775 | 6.835 | 0.171 | 0.252 |
| BnaC.FAD2.a | 0.007 | 0.009 | 5.048 | 6.122 | 0.177 | 0.316 |
| BnaC.FAD2.b | 0.003 | 0.016 | 3.599 | 4.587 | 0.044 | 0.104 |
| Avg. | 0.005 | 0.012 | 4.474 | 5.848 | 0.131 | 0.224 |

Figure 5:
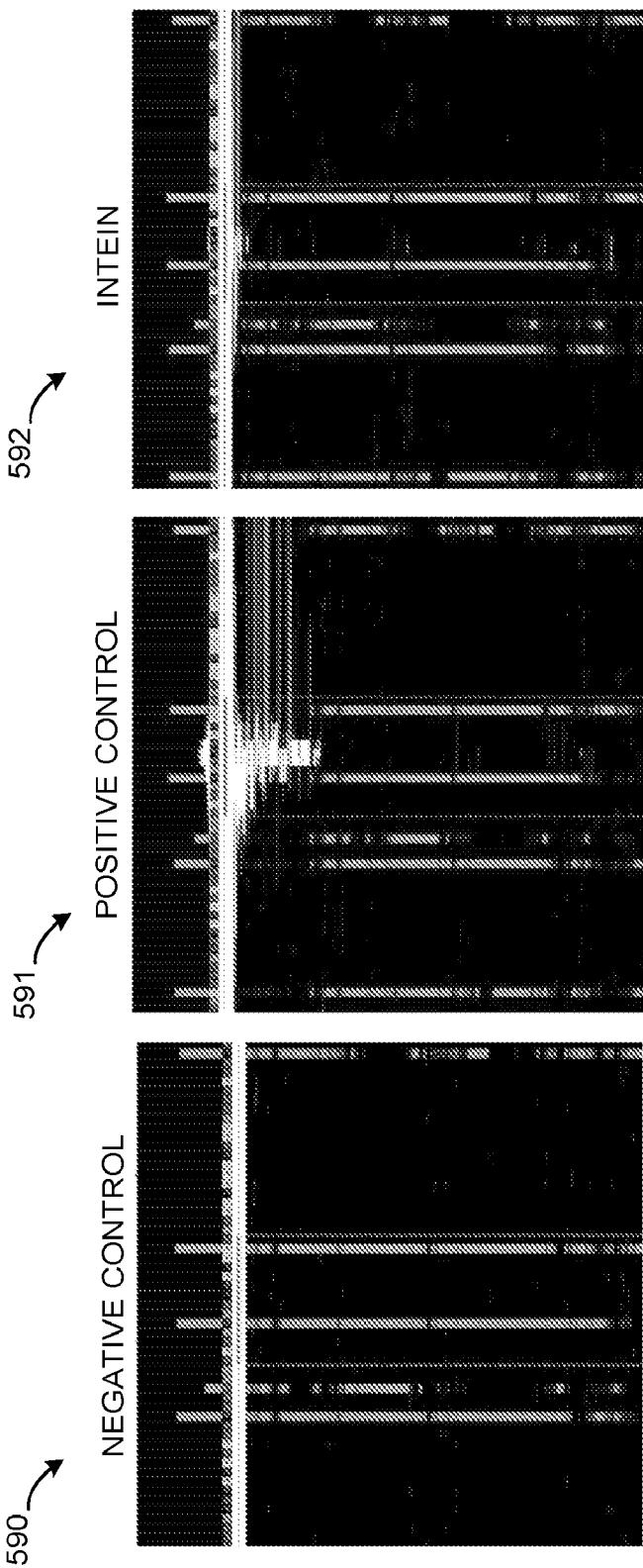
FIG. 5 illustrates images showing resulting genotyping from editing a cell using nucleotide sequences, consistent with the present disclosure.

FIG. 5 illustrates images showing resulting genotyping from editing a cell using nucleotide sequences, consistent with the present disclosure. More particularly, FIG. 5 illustrates aligned images of genomic regions of the negative control 590, the positive control 591, and the intein 592.

Figure 6A:
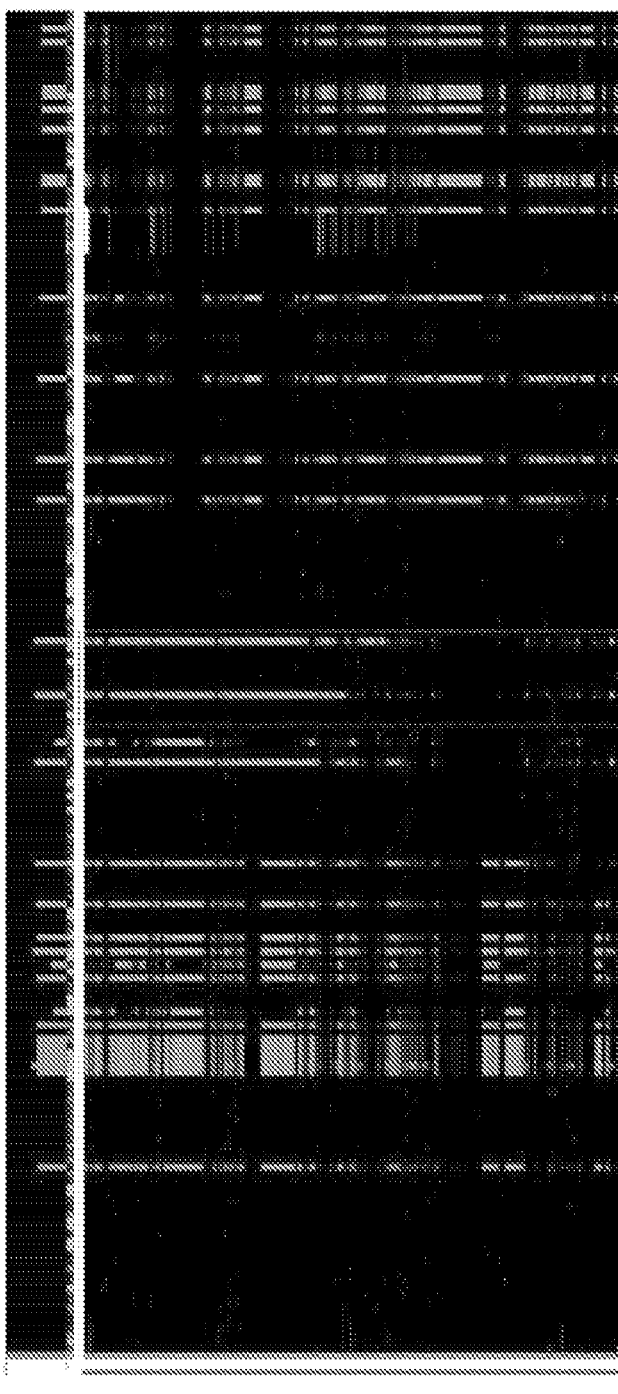
FIGS. 6A-6C illustrate full images of the genomic regions from an YFP negative control, a TALEN positive control, and inteins, consistent with the present disclosure.
Figure 6B:
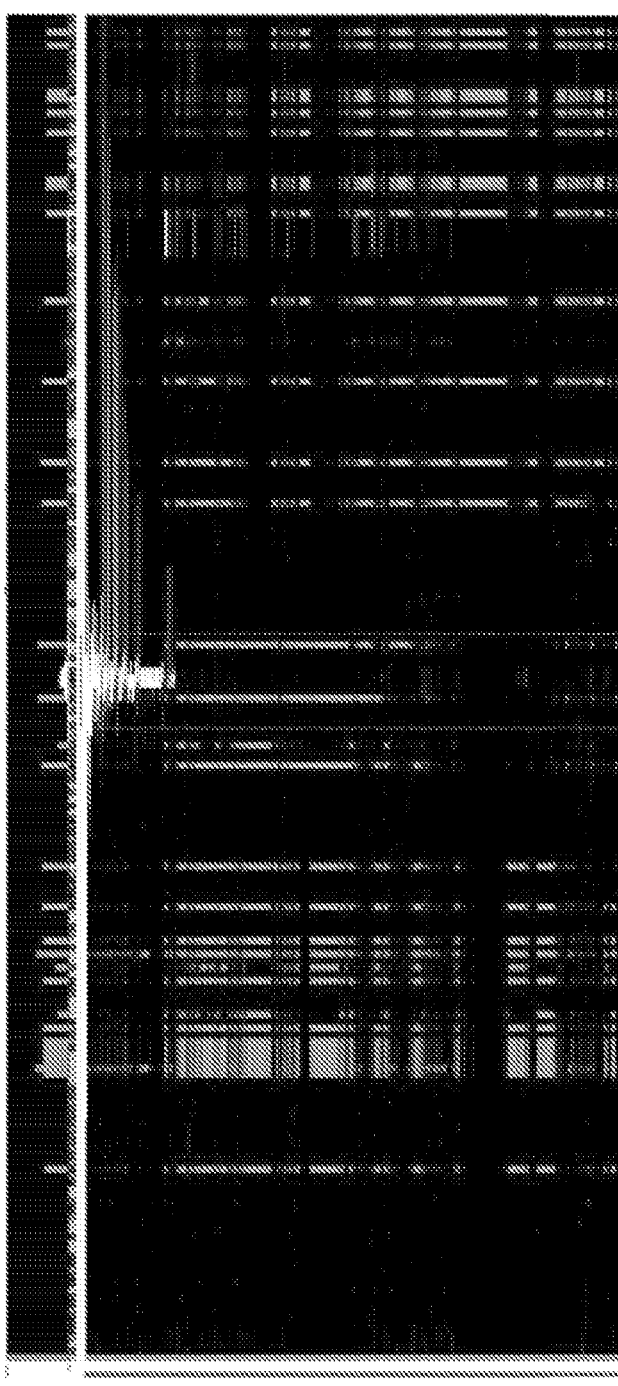
Figure 6C:
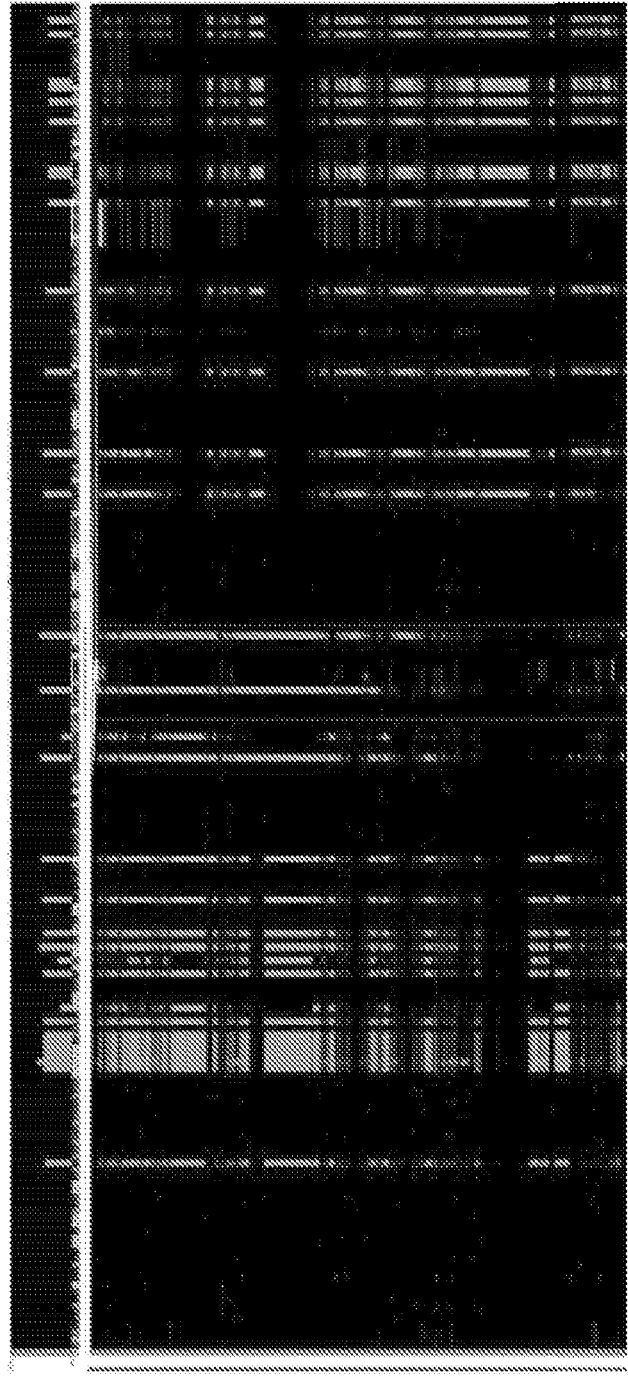

FIGS. 6A-6C illustrate full images of the genomic regions from an YFP negative control, a TALEN positive control, and inteins, consistent with the present disclosure. For example, FIG. 6A illustrates an image of genomic regions of Sample A YFP negative control. FIG. 6B illustrates an image of genomic regions of Sample B (+) BnFAD2 (T03) TALEN positive control. FIG. 6C illustrates an image of genomic regions of Sample C (+) Inteins.

Various experiments were conducted using additional plasmid vectors to transform plant cells, such as canola, cannabis and/or soybean plant cells. Although the examples describe particular plant cells, embodiments are not so limited and may include any type of plant and/or cells other than plants, such as mammal cells. Different types of inteins were using including Ssp DNAE and Gp41-1, native and non-native exteins, and TALEs having binding domains specific for different targets. The experiments further included positive controls that included TALENS and negative controls with no TALEs.

Some experiments were conducted using additional plasmid vectors to transform soybean plant cells using the TALEs associated with different genes, such as a synthase (ALS) transgene, fatty acid desaturase 3 (FAD3) transgene, and growth regulating factor (GRF) transgene. Example constructs and sequences used to experimental embodiments include the nucleotide sequences set forth in SEQ ID NOs: 92-159. The following Tables 6-8 illustrate different plasmid vectors.

TABLE 6

| Name | Composition | Description |
|------|-------------|-------------|
| Plasmid Vector 154 | NosPro-TALE-GmALS (T04-L)- Ssp DnaE int-n-NosTerm | Left TAL effector with GmALS_T04 DNA binding domain fused to an Ssp DnaE int-n sequence |
| Plasmid Vector 155 | NosPro-TALE-GmALS (T04-R)- Ssp DnaE int-n-NosTerm | Right TAL effector with GmALS_T04 DNA binding domain fused to an Ssp DnaE int-n sequence |
| Plasmid Vector 127 | NosPro-Ssp DnaE int-c-FokI-NosTerm | FokI endonuclease fused to an Ssp DnaE int-c peptide sequence |
| Plasmid Vector 132 | NosPro-Ssp DnaE int-c-extein-FokI-NosTerm | FokI endonuclease fused to an Ssp DnaE int-c peptide sequence with native CFN extein |
| Plasmid Vector 149 | NosPro-TALE-GmALS (T04-L)-gp41-1 int-n-NosTerm | Left TAL effector with GmALS_T04 DNA binding domain fused to a gp41-1 int-n sequence |
| Plasmid Vector 150 | NosPro-TALE-GmALS (T04-R)-gp41-1 int-n-NosTerm | Right TAL effector with GmALS_T04 DNA binding domain fused to a gp41-1 int-n sequence |
| Plasmid Vector 131 | NosPro-gp41-1 int-c-FokI-NosTerm | FokI endonuclease fused to a gp41-1 int-c peptide sequence |
| Plasmid Vector 122 | NosPro-TALE-GmALS (T04-L)-N-NosTerm | Control LHT with GmALS_T04 DNA binding domain |
| Plasmid Vector 123 | NosPro-TALE-GmALS (T04-R)-N-NosTerm | Control RHT with GmALS_T04 DNA binding domain |

TABLE 7

| Sample | AA | G | H | I | J |
|--------|-----|-----|-----|-----|-----|
| Plasmid 1 | Negative control | Plasmid Vector 154 | Plasmid Vector 154 | Plasmid Vector 149 | Plasmid Vector 122 |
| Description | pVaUbi3_YFP_NosTerm (negative control) | NosPro-TALE-GmALS (T04-L)-Ssp DnaE int-n-NosTerm | NosPro-TALE-GmALS (T04-L)-Ssp DnaE int-n-NosTerm | NosPro-TALE-GmALS (T04-L)-gp41-1 int-n-NosTerm | NosPro-TALE-GmALS (T04-L)-N-NosTerm |
| Type | DNA | DNA | DNA | DNA | DNA |
| Per 100k cells (ug) | 15 | 15 | 15 | 15 | 15 |
| Total Quantity (ug) | 30 | 30 | 30 | 30 | 30 |
| Conc. (ug/ul) | 0.9 | 0.9 | 0.9 | 0.9 | 0.9 |
| Vol. (ul) | 100 | 100 | 100 | 100 | 100 |
| Protoplast # | 200K | 200K | 200K | 200K | 200K |
| Plasmid 2 | | Plasmid Vector 155 | Plasmid Vector 155 | Plasmid Vector 150 | Plasmid Vector 123 |

TABLE 7-continued

| Sample | AA | G | H | I | J |
|---|---|---|---|---|---|
| Description | | NosPro-TALE-GmALS (T04-R)-Ssp DnaE int-n-Nos Term | NosPro-TALE-GmALS (T04-R)-Ssp DnaE int-n-NosTerm | NosPro-TALE-GmALS (T04-R)-gp41-1 int-n-NosTerm | NosPro-TALE-GmALS (T04-R)-N-NosTerm |
| Type | | DNA | DNA | DNA | DNA |
| Per 100k cells (ug) | | 15 | 15 | 15 | 15 |
| Total Quantity (ug) | | 30 | 30 | 30 | 30 |
| Conc. (ug/ul) | | 0.9 | 0.9 | 0.9 | 0.9 |
| Vol. (ul) | | 100 | 100 | 100 | 100.00 |
| Plasmid 3 | | Plasmid Vector 127 | Plasmid Vector 132 | Plasmid Vector 131 | |
| Description | | NosPro-Ssp DnaE int-c-FokI-NosTerm | NosPro-Ssp DnaE int-c-extein-FokI-NosTerm | NosPro-gp41-1 int-c-FokI-NosTerm | |
| Type | | DNA | DNA | DNA | |
| Per 100k cells (ug) | | 15 | 15 | 15 | |
| Total Quantity (ug) | | 30 | 30 | 30 | |
| Conc. (ug/ul) | | 0.9 | 0.9 | 0.9 | |
| Vol. (ul) | | 100 | 100 | 100 | |
| Note | Negative control | Intein sample | Intein sample | Intein sample | Positive control |

TABLE 8

| Sample | Biological replicate | Sample description | Percent events |
|---|---|---|---|
| AA | 1 | pVaUbi3__YFP__NosTerm negative control | 0.035018 |
| AA | 2 | pVaUbi3__YFP__NosTerm negative control | 0.048517 |
| G | 1 | Ssp DnaE Intein TALEN sample | 3.728738 |
| G | 2 | Ssp DnaE Intein TALEN sample | 4.145849 |
| H | 1 | Ssp DnaE Native Extein Intein TALEN sample | 8.979292 |
| H | 2 | Ssp DnaE Native Extein Intein TALEN sample | 7.736866 |
| I | 1 | Gp41-1 Intein TALEN sample | 8.30517 |
| I | 2 | Gp41-1 Intein TALEN sample | 8.629669 |
| J | 1 | TALEN positive control | 1.643263 |
| J | 2 | TALEN positive control | 2.329923 |

In various experiments, soybean protoplasts were transformed using the above described plasmid vectors and in accordance with the protocol as described in Xiong, L., et al., "A transient expression system in soybean mesophyll protoplasts reveals the formation of cytoplasmic GmCRY1 photobody-like structures", Science China Life Sciences, 2019, 62(8), 1070-1077, which is hereby incorporated in its entirety for its teaching, and in addition to further plasmid vectors. In some examples, 2.4 million cells were combined in the replicate tubes for 12×200,000 cells per bio-replication. An average of 180 per square was identified, which equates to 3.6M cells as a 4 mL volume was used. Then proceeded as described for the rest of the protocol.

Samples were as follows:

two bioreplications of each (for example for sample 1: 1A and 1B with 200K cells for each; and each Sample #1-6 has each plasmid at a final concentration of 300 ng/uL. Table 9 provide the different samples that were tested:

TABLE 9

| Sample | Target | Intein | Extein | Plasmid |
|---|---|---|---|---|
| 1 | GmFAD3_T08 | Ssp DnaE | Nonnative | Plasmid Vector 110 - Ssp DnaE GmGRF_T03-L1 |
| | | | | Plasmid Vector 152 - Ssp DnaE GmGRF_T03-R1 |
| | | | | Plasmid Vector 127 - Ssp DnaE intC non-native |
| 2 | GmFAD3_T08 | Ssp DnaE | Native | Plasmid Vector 110- Ssp DnaE GmGRF_T03-L1 |
| | | | | Plasmid Vector 152 - Ssp DnaE GmGRF_T03-R1 |
| | | | | Plasmid Vector 132 - Ssp DnaE intC native |
| 3 | GmFAD3_T08 | Gp41-1 | Nonnative | Plasmid Vector 137 - GmFAD3_T08-L1 gp41-1 non-native |
| | | | | Plasmid Vector 145 - GmFAD3_T08-R1 gp41-1 non-native |
| | | | | Plasmid Vector 131- gp41-1 intC non-native |
| 4 | GmFAD3_T08 | Gp41-1 | Native | Plasmid Vector 134- GmFAD3_T08-L1 gp41-1 native |
| | | | | Plasmid Vector 141 - GmFAD3_T08-R1 gp41-1 native |
| | | | | Plasmid Vector 130 - gp41-1 intC native |
| 5 | GmFAD3_T08 | N/A | | pCLScontrol - GmFAD3_T08-L1 |
| | | | | Plasmid Vector 126 - GmFAD3_T08-R1 |
| 6 | Negative Control | | | Negative control plasmid |

** Plasmid vector 152 and plasmid vector 110 used lower [dna] to divide between experiments 1 and 2. For plasmid vector 152 (295 ng/uL) and for plasmid vector 110 (244 ng/uL).

Each sample was made to a final volume of 220 uL to compensate for pipetting error, from the stock concentrations and volumes listed below. For example the following describes the Samples 1-5 protoplasts preparations on plates (e.g., 2 per sample). The protoplast were summed to include 1 uL of solution ×1000 mL×4 mL (total volume). Table 10 provides the sum for each sample preparation.

TABLE 10

| Sample | Volume |
| --- | --- |
| 1 | 491 |
| 2 | 829 |
| 3 | 549 |
| 4 | 710 |
| 5 | 119 |

The above resulted in a total 3119 cells (per uL)×1000 (convert to mL)×4 (4 ml total volume each)=12.5 million cells. The cells were divided into 200,000 each (320 uL) dived into tubes.

For examples, the cells were divided into 200,000 bio-replicated tubes with 2 per set up below. Following washings and quantification: pelleted cells, removed W5, then used 2×MMG (100 ul+100 uL of the indicated DNA below). Then proceeded as described for the rest of the protocol (final spin after PEG addition still using 100 g for 5 min not 200 g). Following transformation and washes, transferred in 1 mL of W5 solution to 24 well plate kept in the dark. Samples are as follows:

a. Two bio-replicated of each (for example for sample 1: 1A and 1B with 200K cells for each; and b. Each Sample #1-6 has each plasmid at a final concentration of 300 ng/uL.

Table 11 below provides additional plasmid vectors provided on the different blocks and for the different samples. Each sample is listed as 1.1 for block 1 sample 1 and A and B indicate the individual bio-replications.

TABLE 11

| Block | Sample | Target | Intein | Extein | Plasmids |
| --- | --- | --- | --- | --- | --- |
| 1 | 1 | GmALS_T04 | Ssp DnaE | Non-native | Plasmid Vector 154 - Ssp DnaE GmALS_T04-L1 Plasmid Vector 155 - Ssp DnaE GmALS_T04-R1 Plasmid Vector 127 - Ssp DnaE intC non-native |
| | 2 | GmALS_T04 | Ssp DnaE | Native | Plasmid Vector 154 - Ssp DnaE GmALS_T04-L1 Plasmid Vector 155- Ssp DnaE GmALS_T04-R1 Plasmid Vector 132 - Ssp DnaE intC native |
| | 3 | GmALS_T04 | Gp41-1 | Non-native | Plasmid Vector 149 - gp41-1 intN non-native GmALS_T04-L1 Plasmid Vector 150 - gp41-1 intN non-native GmALS_T04-R1 Plasmid Vector 131 - gp41-1 intC non-native in pCLS30416 |
| | 4 | GmALS_T04 | Gp41-1 | Native | Plasmid Vector 147 - gp41-1 intN native GmALS_T04-L1 Plasmid Vector 148 - gp41-1 intN native GmALS_T04-R1 Plasmid Vector 130 - gp41-1 intC native in pCLS30416 |
| | 5 | GmALS_T04 | Standard TALEN | | Plasmid Vector 122 - GmALS_T04-L1 Plasmid Vector 123 - GmALS_T04-R1 |
| | 6 | | Negative control | | Negative control plasmid |
| | 7 | AvYFP_T02 | Negative control | | Plasmid Vector 128 - AvYFP_T02-L1 Plasmid Vector 129 - AvYFP_T02-R1 |
| 2 | 1 | GmALS_T07 | Ssp DnaE | Non-native | Plasmid Vector 156 - Ssp DnaE GmALS_T07-L1 Plasmid Vector 157 - Ssp DnaE GmALS_T07-R1 Plasmid Vector 127 - Ssp DnaE intC non-native |
| | 2 | GmALS_T07 | Ssp DnaE | Native | Plasmid Vector 156- Ssp DnaE GmALS_T07-L1 Plasmid Vector 157- Ssp DnaE GmALS_T07-R1 Plasmid Vector 132- Ssp DnaE intC native |

TABLE 11-continued

| Block | Sample | Target | Intein | Extein | Plasmids |
|---|---|---|---|---|---|
| | 3 | GmALS_T07 | Gp41-1 | Non-native | Plasmid Vector 138- GmALS_T07-L1 gp41-1 non-native Plasmid Vector 146 - GmALS_T07-R1 gp41-1 non-native Plasmid Vector 131- gp41-1 intC non-native in pCLS30416 |
| | 4 | GmALS_T07 | Gp41-1 | Native | Plasmid Vector 135 - GmALS_T07-L1 gp41-1 native Plasmid Vector 142- GmALS_T07-R1 gp41-1 native Plasmid Vector 130 - gp41-1 intC native in pCLS30416 |
| | 5 | GmALS_T07 | Standard TALEN | | Plasmid Vector 124 - GmALS_T07-L1 Plasmid Vector 125 - GmALS_T07-R1 |
| | 6 | | Negative control | | Negative control plasmid |
| 3* | | | | | |
| 4 | 1 | GmGRF_T03 | Ssp DnaE | Non-native | Plasmid Vector 153 - Ssp DnaE GmGRF_T04-L1 Plasmid Vector 151 - Ssp DnaE GmGRF_T04-R1 Plasmid Vector 127 - Ssp DnaE intC nonnative |
| | 2 | GmGRF_T03 | Ssp DnaE | Native | Plasmid Vector 153- Ssp DnaE GmGRF_T04-L1 Plasmid Vector 151 - Ssp DnaE GmGRF_T04-R1 Plasmid Vector 132 - Ssp DnaE intC native |
| | 3 | GmGRF_T03 | Gp41-1 | Non-native | Plasmid Vector 136 - GmGRF3_T04-L1 gp41-1 non-native Plasmid Vector 143- GmGRF3_T04-R1 gp41-1 non-native Plasmid Vector 131- gp41-1 intC nonnative in pCLS30416 |
| | 4 | GmGRF_T03 | Gp41-1 | Native | Plasmid Vector 92 - GmGRF3_T03-L1 gp41-1 native Plasmid Vector 140 - GmGRF3_T03-R1 gp41-1 native Plasmid Vector 130 - gp41-1 intC native in pCLS30416 |
| | 5 | GmGRF_T03 | Standard TALEN | | Plasmid Vector 120 - GmGRF_T03-L1 Plasmid Vector 119 - GmGRF_T03-R1 |
| | 6 | | Negative control | | Negative control |
| 5 | 1 | GmGRF_T04 | Ssp DnaE | Non-native | Plasmid Vector 158 - Ssp DnaE GmFAD3_T08-L1 Plasmid Vector 159 - Ssp DnaE GmFAD3_T08-R1 Plasmid Vector 127- Ssp DnaE intC nonnative |
| | 2 | GmGRF_T04 | Ssp DnaE | Native | Plasmid Vector 158 - Ssp DnaE GmFAD3_T08-L1 Plasmid Vector 159 - Ssp DnaE GmFAD3_T08-R1 Plasmid Vector 132 - Ssp DnaE intC native |
| | 3 | GmGRF_T04 | Gp41-1 | Non-native | Plasmid Vector 102- GmGRF3_T03-L1 gp41-1 non-native Plasmid Vector 144 - GmGRF3_T03-R1 gp41-1 non-native Plasmid Vector 131- gp41-1 intC non-native in pCLS30416 |
| | 4 | GmGRF_T04 | Gp41-1 | Native | Plasmid Vector 133 - GmGRF3_T04-L1 gp41-1 native Plasmid Vector 139 - GmGRF3_T04-R1 gp41-1 native Plasmid Vector 130 - gp41-1 intC native in pCLS30416 |

TABLE 11-continued

| Block | Sample | Target | Intein | Extein | Plasmids |
|---|---|---|---|---|---|
| | 5 | GmGRF_T04 | Standard TALEN | | Plasmid Vector 121 - GmGRF_T04-L1 Plasmid Vector 118 - GmGRF_T04-RI |
| | 6 | | Negative control | | Negative control plasmid |

In the above, block 3 in Table 11 corresponds to Table 9.

Figure 7:
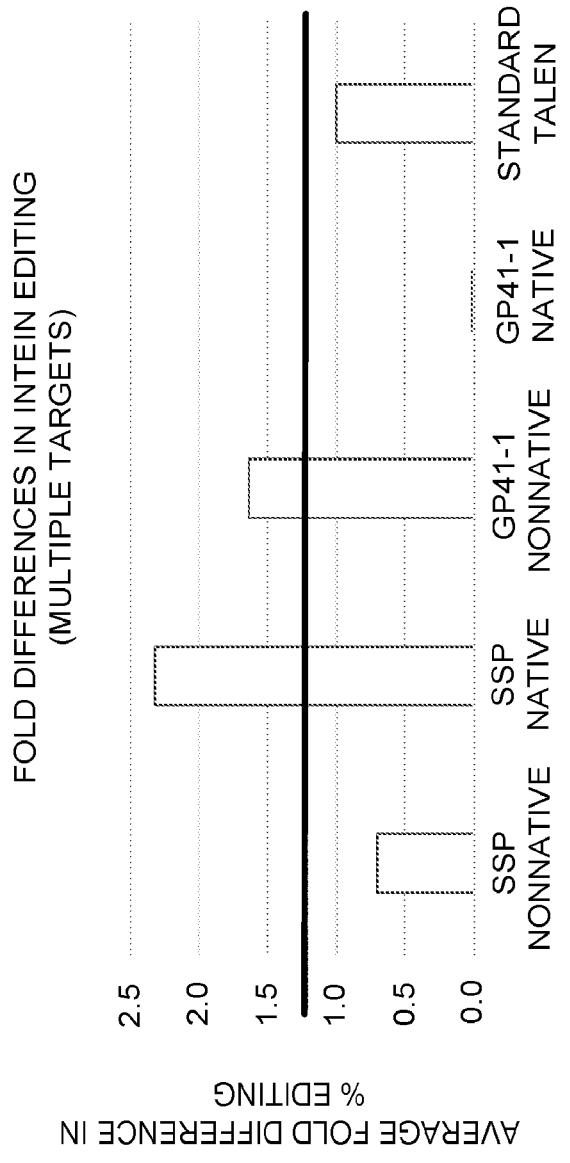
FIG. 7 illustrates example results of transforming soybean explants using the different plasmid vectors, consistent with the present disclosure.

FIG. 7 illustrates example results of transforming soybean explants using the different plasmid vectors, consistent with the present disclosure. More particularly, soybean protoplasts were transformed using co-delivered vectors encoding for a left TALE fused to a first intein, a right TALE fused to the first intein, and a nuclease fused to the second intein. The TALEs included binding domains associated with genes for ALS, FAD3, and GRF.

The different plasmid vectors included a first set that targeted the ALS gene (e.g., including ALS-T04 and ALS-T07 and plasmid vectors 154, 155, 149, 150, 147, 148, 122, 123, 156, 157, 138, 146, 135, 142, 124, and 125), a second set that targeted the FAD3 gene (e.g., including FAD3-T08 and plasmid vectors 110, 152, 137, 145, 134, 141, and 126), and a third set that targeted the GRF gene (e.g., including GRF-T03 and GRF-T04 and plasmid vectors 153, 151, 136, 143, 92, 140, 120, 119, 158, 159, 102, 144, 133 139, 121, and 123). Within each of the first, second, and third sets, respective vectors included no inteins (plasmid vector groups of (plasmid vector 122 and plasmid vector 123), (plasmid vector 124 and plasmid vector 125), (plasmid vector control and plasmid vector 126), (plasmid vector 120 and plasmid vector 119), and (plasmid vector 121 and plasmid vector 123), inteins of SSP DnaE and non-native exteins (plasmid vector groups of (plasmid vector 154, plasmid vector 155 and plasmid vector 127), (plasmid vector 156, plasmid vector 157, plasmid vector 127), (plasmid vector 110, plasmid vector 152, plasmid vector 127), and (plasmid vector 153, plasmid vector 151, plasmid vector 127), inteins of SSP DnaE and native exteins (plasmid vectors groups of (plasmid vector 154, plasmid vector 155, and plasmid vector 132), (plasmid vector 156, plasmid vector 157, and plasmid vector 132), (plasmid vector 158, plasmid vector 159, and plasmid vector 132), (plasmid vector 110, plasmid vector 152, plasmid vector 132), and (plasmid vector 153, plasmid vector 151, plasmid vector 132), inteins of GP41-1 and non-native exteins (plasmid vector groups of (plasmid vector 149, plasmid vector 150, and plasmid vector 131), (plasmid vector 138, plasmid vector 146, and plasmid vector 131), (plasmid vector 137, plasmid vector 145, and plasmid vector 131), (plasmid vector 102, plasmid vector 144, and plasmid vector 131), and (plasmid vector 136, plasmid vector 143, and plasmid vector 131), and inteins of GP41-1 and native exteins (plasmid vector groups of (plasmid vector 147, plasmid vector 148, and plasmid vector 130), (plasmid vector 135, plasmid vector 142, and plasmid vector 130), (plasmid vector 134, plasmid vector 141, and plasmid vector 130), (plasmid vector 92, plasmid vector 140, and plasmid vector 130), and (plasmid vector 144, plasmid vector 139, and plasmid vector 130). Example negative control plasmid vectors include plasmid vector 128 (as set forth in SEQ ID NO: 128) and plasmid vector 129 (as set forth in SEQ ID NO: 129).

As described above, three plasmid vectors can be used in each experiment to jointly demonstrate TALEN gene activity, with two of three plasmid vectors including a TAL effector that targets a gene (e.g., left and right half TAL effectors) fused to an intein (e.g., int-N or int-C) and the third plasmid vector including an intein (e.g., int-C or int-N) fused to the FokI endonuclease. Different vectors can include a TAL effector that targets the gene GRF3, FAD3, or ALS fused to an Ssp DnaE int-N or gp41-1 int-N peptide sequence. Plasmid vector 92 (SEQ ID NO: 92) encodes a promoter NosPro, a TAL effector targeting the gene GRF3, an Gp41-1 int-N peptide sequence native, a terminator NosTerm, and a left HT backbone. Plasmid vector 102 (SEQ ID NO: 102) encodes a promoter NosPro, a TAL effector targeting the gene GRF3, an Gp41-1 int-N peptide sequence non-native, a terminator NosTerm, and a left HT backbone. Plasmid vector 110 (SEQ ID NO: 110) encodes a promoter NosPro, a TAL effector targeting the gene GRF3, and a Ssp DnaE int-N peptide sequence, a terminator NosTerm, and a left HT backbone.

A sequence of plasmid vector 92 is set forth in SEQ ID NO: 92, which encodes a left half TALE cassette (SEQ ID NO: 93) including a Nos promoter (SEQ ID NO: 94), an intein TAL effector fusion (SEQ ID NO: 95), and a Nos terminator (SEQ ID No: 33). The intein TAL effector fusion (SEQ ID NO: 95) encodes a left TALE N-terminal (SEQ ID NO: 96), GmGRF3 (T03-L1) binding domain (SEQ ID NO: 97), left TALE C-terminal (SEQ ID NO: 98), a linker (SEQ ID NO: 99), a native splice site int-N(SEQ ID NO: 100), and Gp41-1 int-N peptide sequence (SEQ ID NO: 101).

A sequence of plasmid vector 102 is set forth in SEQ ID NO: 102, which encodes a left half TALE cassette (SEQ ID NO: 103) including a Nos promoter (SEQ ID NO: 94), an intein TAL effector fusion (SEQ ID NO: 104), and a Nos terminator (SEQ ID No: 33). The intein TAL effector fusion (SEQ ID NO: 104) encodes a left TALE N-terminal (SEQ ID NO: 105), GmGRF3 (T03-L1) binding domain (SEQ ID NO: 106), left TALE C-terminal (SEQ ID NO: 107), a linker (SEQ ID NO: 108), and Gp41-1 int-N peptide sequence (SEQ ID NO: 109).

A sequence of plasmid vector 110 is set forth in SEQ ID NO: 110, which encodes a left half TALE cassette (SEQ ID NO: 111) including a Nos promoter (SEQ ID NO: 94), an intein TAL effector fusion (SEQ ID NO: 112), and a Nos terminator (SEQ ID No: 33). The intein TAL effector fusion (SEQ ID NO: 112) encodes a left TALE N-terminal (SEQ ID NO: 113), GmGRF3 (T03-L1) binding domain (SEQ ID NO: 114), left TALE C-terminal (SEQ ID NO: 115), a linker (SEQ ID NO: 116), and Ssp DnaE int-N peptide sequence (SEQ ID NO: 117).

The remaining example constructs are described below. Plasmid vector 118 (set forth in SEQ ID NO: 118) is a control TALEN vector that encodes a right half TALEN targeted to GmGRF (T04) and plasmid vector 119 (set forth in SEQ ID NO: 119) is a control TALEN vector that encodes a right half TALEN targeted to GmGRF (T03). Plasmid vector 120 (set forth in SEQ ID NO: 120) is a control TALEN vector that encodes a left half TALEN targeted to GmGRF (T03) and plasmid vector 121 (set forth in SEQ ID NO: 121) is a control TALEN vector that encodes a left half TALEN targeted to GmGRF (T04). Plasmid vector 122 (set forth in SEQ ID NO: 122) is a control TALEN vector that encodes a left half TALEN targeted to GmALS (T04) and plasmid vector 123 (set forth in SEQ ID NO: 123) is a control TALEN vector that encodes a right half TALEN targeted to GmALS (T04). Plasmid vector 124 (set forth in SEQ ID NO: 124) is a control TALEN vector that encodes a left half TALEN targeted to GmALS (T07) and plasmid vector 125 (set forth in SEQ ID NO: 125) is a control TALEN vector that encodes a right half TALEN targeted to GmALS (T07). Plasmid vector 126 (set forth in SEQ ID NO: 126) is a control TALEN vector that encodes a right half TALEN targeted to GmFAD3 (T08).

Plasmid vector 127 (set forth in SEQ ID NO: 127) encodes an Ssp DnaE int-C peptide sequence, with a non-native extein, and a FokI endonuclease. As previously described, plasmid vectors 128 and 129 (set forth in SEQ ID NOs: 128-129) are TALEN controls with YFP, with plasmid vector 128 including a left half TALEN and plasmid vector 129 including a right half TALEN vector. Plasmid vector 130 (set forth in SEQ ID NO: 130) encodes a gp41-1 int-C peptide sequence, with a native extein, and a FokI endonuclease. Plasmid vector 131 (set forth in SEQ ID NO: 131) encodes a gp41-1 int-C peptide sequence, with a non-native extein, and a FokI endonuclease. Plasmid vector 132 (set forth in SEQ ID NO: 132) is an Ssp DnaE int-C peptide sequence, with a native extein, and a FokI endonuclease.

Plasmid vector 133 (set forth in SEQ ID NO: 133) encodes a left half TAL effector targeting the gene GRF3 (T04) fused to a Gp41-1 int-N peptide sequence native. Plasmid vector 134 (set forth SEQ ID NO: 134) encodes a left half TAL effector targeting the gene FAD3 (T08) fused to a Gp41-1 int-N peptide sequence native. Plasmid vector 135 (set forth SEQ ID NO: 135) encodes a left half TAL effector targeting the gene ALS (T07) fused to a Gp41-1 int-N peptide sequence native.

Plasmid vector 136 (set forth in SEQ ID NO: 136) encodes a left half TAL effector targeting the gene GRF3 (T04) fused to a Gp41-1 int-N peptide sequence non-native. Plasmid vector 137 (set forth SEQ ID NO: 137) encodes a left half TAL effector targeting the gene FAD3 (T08) fused to a Gp41-1 int-N peptide sequence non-native. Plasmid vector 138 (set forth SEQ ID NO: 138) encodes a left half TAL effector targeting the gene ALS (T07) fused to a Gp41-1 int-N peptide sequence non-native.

Plasmid vector 139 (set forth in SEQ ID NO: 139) encodes a right half TAL effector targeting the gene GRF3 (T04) fused to a Gp41-1 int-N peptide sequence native. Plasmid vector 140 (set forth in SEQ ID NO: 140) encodes a right half TAL effector targeting the gene GRF3 (T03) fused to a Gp41-1 int-N peptide sequence native. Plasmid vector 141 (set forth SEQ ID NO: 141) encodes a right half TAL effector targeting the gene FAD3 (T08) fused to a Gp41-1 int-N peptide sequence native. Plasmid vector 142 (set forth SEQ ID NO: 142) encodes a left half TAL effector targeting the gene ALS (T07) fused to a Gp41-1 int-N peptide sequence native.

Plasmid vector 143 (set forth in SEQ ID NO: 143) encodes a right half TAL effector targeting the gene GRF3 (T04) fused to a Gp41-1 int-N peptide sequence non-native. Plasmid vector 144 (set forth in SEQ ID NO: 144) encodes a right half TAL effector targeting the gene GRF3 (T03) fused to a Gp41-1 int-N peptide sequence non-native. Plasmid vector 145 (set forth SEQ ID NO: 145) encodes a right half TAL effector targeting the gene FAD3 (T08) fused to a Gp41-1 int-N peptide sequence non-native. Plasmid vector 146 (set forth SEQ ID NO: 146) encodes a right half TAL effector targeting the gene ALS (T07) fused to a Gp41-1 int-N peptide sequence non-native.

Plasmid vector 147 (set forth in SEQ ID NO: 147) encodes a left half TAL effector targeting the gene ALS (T04) fused to a Gp41-1 int-N peptide sequence native. Plasmid vector 148 (set forth in SEQ ID NO: 148) encodes a right half TAL effector targeting the gene ALS (T04) fused to a Gp41-1 int-N peptide sequence native.

Plasmid vector 149 (set forth in SEQ ID NO: 149) encodes a left half TAL effector targeting the gene ALS (T04) fused to an Gp41-1 int-N peptide sequence, non-native. Plasmid vector 150 (set forth in SEQ ID NO: 150) encodes a right half TAL effector targeting the gene ALS (T04) fused to a Gp41-1 int-N peptide sequence, non-native.

Plasmid vector 151 (set forth in SEQ ID NO: 151) encodes a right half TAL effector targeting the gene GRF3 (T04) fused to an Ssp DnaE int-N peptide sequence. Plasmid vector 152 (set forth in SEQ ID NO: 152) encodes a right half TAL effector targeting the gene GRF3 (T03) fused to an Ssp DnaE int-N peptide sequence. Plasmid vector 153 (set forth in SEQ ID NO: 153) encodes a left half TAL effector targeting the gene GRF3 (T04) fused to an Ssp DnaE int-N peptide sequence.

Plasmid vector 154 (set forth in SEQ ID NO: 154) encodes a left half TAL effector targeting the gene ALS (T04) fused to an Ssp DnaE int-N peptide sequence. Plasmid vector 155 (set forth in SEQ ID NO: 155) encodes a right half TAL effector targeting the gene ALS (T04) fused to an Ssp DnaE int-N peptide sequence. Plasmid vector 156 (set forth in SEQ ID NO: 156) encodes a left half TAL effector targeting the gene ALS (T07) fused to an Ssp DnaE int-N peptide sequence. Plasmid vector 157 (set forth in SEQ ID NO: 157) encodes a right half TAL effector targeting the gene ALS (T07) fused to an Ssp DnaE int-N peptide sequence Plasmid vector 158 (set forth in SEQ ID NO: 158) encodes a left half TAL effector targeting the gene FAD3 (T08) fused to an Ssp DnaE int-N peptide sequence. Plasmid vector 159 (set forth in SEQ ID NO: 159) encodes a right half TAL effector targeting the gene FAD3 (T08) fused to an Ssp DnaE int-N peptide sequence.

For example, FIG. 7 is a graph comparing the editing efficiencies of different plasmid vectors of 92-159 illustrating the editing efficiencies of no inteins, inteins of SSP DnaE and non-native exteins, inteins of SSP DnaE and native exteins, inteins of GP41-1 and non-native exteins, and inteins of GP41-1 and native exteins.

Various experiments were conducted using additional plasmid vectors to transform hemp plant cells using the TALEs associated with different genes, such as a phytoene desaturase (PDS) transgene and a Tetrahydrocannabinolic acid synthase (THCAS) transgene.

Cannabis plant cells were transformed via an agrobacterium mediated transformation of cannabis embryonic axis (EA) tissues. Briefly, the cannabis seeds were sterilized using a hydrogen peroxide wash. After the sterilization, the seeds were imbibed overnight in a liquid antibiotic solution. After the overnight imbibe, the cannabis embryos were removed from the seed coat, and EA tissues were harvested by removing the cotyledons and primary leaves.

The cannabis EA tissues were then placed in a petri plate containing liquid infection solution which consisted of medium plus agrobacterium carrying the binary vector of interest at an OD of 0.2. The infection petri plate containing the EAs in agrobacterium solution was sealed and sonicated for 40 seconds. After sonication, the EAs were kept in the infection medium for one hour. After one hour, the EAs were removed from the infection medium and plated onto new co-cultivation petri plates containing a wet filter paper. The plates were sealed and placed in an incubator at 16/8 hr light, 23 C for four days. After co-cultivation, the EAs were plated onto petri plates containing a regeneration medium. The regeneration plates containing the EAs were sealed and placed into an incubator at 16/8 hr light, 23 C for 7 days. The EAs can be transformed using any technique which is well-known in the field.

After 7 days on regeneration medium, the EAs were removed from the medium and frozen at −80 C for DNA extraction using any well-known technique. For example, the DNA extraction can be implemented as described in US Publication 2021/0277411, published on Sep. 9, 2021, and entitled "Canola with High Oleic Acid", which is hereby incorporated herein in its entirety for its teaching.

In various experiments, cannabis plant cells were transformed with plasmid vectors as set forth in SEQ ID NOs: 20-91. The cannabis EAs were transformed using the Cannabaceae transformation protocol described above and using bacterium containing a respective binary vector. In various embodiments, the editing efficiencies were compared between the different plasmid vectors. The different plasmid vectors included a first set that targeted the PDS gene (e.g., plasmid vectors 91, 20, 46, and 87) and a second set that targeted the THCAS gene (e.g., plasmid vectors 90, 88, 89, and 65). Within each of the first set and the second set, respective vectors included no inteins (e.g., plasmid vectors 90 and 91), inteins of SSP DnaE and native exteins (e.g., plasmid vectors 20, and 87), inteins of GP41-1 and non-native exteins (e.g., plasmid vectors 46 and 88), and inteins of GP41-1 and native exteins (e.g., plasmid vectors 89 and 65).

A sequence of plasmid vector 20 is set forth in SEQ ID NO: 20, which encodes an YFP cassette (SEQ ID NO: 21), a left half TALE cassette (SEQ ID NO: 25), a right half TALE cassette (SEQ ID NO: 34), and a FokI cassette (SEQ ID NO: 41). The YFP cassette encodes a FMV promoter (SEQ ID NO: 22), a YFP protein (SEQ ID NO: 23), and a Rbcs terminator (SEQ ID NO: 24). The left half TALE cassette (SEQ ID NO: 25) encodes a VaUbi3 promoter (SEQ ID NO: 26), an intein TAL effector fusion (SEQ ID NO: 27), and a Nos terminator (SEQ ID NO: 33). The intein TAL effector fusion (SEQ ID NO: 27) encodes a left TALE N-terminal (SEQ ID NO: 28), CsPDS (T02-L1) binding domain (SEQ ID NO: 29), left TALE C-terminal (SEQ ID NO: 30), a linker (SEQ ID NO: 31), and Ssp DnaE int-N peptide sequence (SEQ ID NO: 32). The right half TALE cassette (SEQ ID NO: 34) encodes a VaUbi3 promoter (SEQ ID NO: 26), an intein TAL effector fusion (SEQ ID NO: 35), and a Nos terminator (SEQ ID NO: 33). The intein TAL effector fusion (SEQ ID NO: 35) encodes a right TALE N-terminal (SEQ ID NO: 36), CsPDS (T02-R1) binding domain (SEQ ID NO: 37), right TALE C-terminal (SEQ ID NO: 38), a linker (SEQ ID NO: 39), and Ssp DnaE int-N peptide sequence (SEQ ID NO: 40). The FokI cassette (SEQ ID NO: 41) encodes an MtEFla promoter (SEQ ID NO: 42), an intein FokI fusion (SEQ ID NO: 43), and a Nos terminator (SEQ ID NO: 33). The intein FokI fusion (SEQ ID NO: 43) encodes a nuclear localization signal (SEQ ID NO: 44), an Ssp DnaE int-C peptide sequence (SEQ ID NO: 45), a CFN (TGCTTCAAC), a linker (AGCCGTTCC), and FokI (SEQ ID NO: 19).

A sequence of plasmid vector 46 is set forth in SEQ ID NO: 46, which encodes an YFP cassette (SEQ ID NO: 21), a left half TALE cassette (SEQ ID NO: 47), a right half TALE cassette (SEQ ID NO: 54), and a FokI cassette (SEQ ID NO: 61). The YFP cassette encodes a FMV promoter (SEQ ID NO: 22), an YFP protein (SEQ ID NO: 23), and an Rbcs terminator (SEQ ID NO: 24). The left half TALE cassette (SEQ ID NO: 47) encodes a VaUbi3 promoter (SEQ ID NO: 26), an intein TAL effector fusion (SEQ ID NO: 48), and a Nos terminator (SEQ ID NO: 33). The intein TAL effector fusion (SEQ ID NO: 48) encodes a left TALE N-terminal (SEQ ID NO: 49), CsPDS (T02-L1) binding domain (SEQ ID NO: 50), left TALE C-terminal (SEQ ID NO: 51), a linker (SEQ ID NO: 52), and Gp41-1 int-N peptide sequence (SEQ ID NO: 53). The right half TALE cassette (SEQ ID NO: 54) encodes a VaUbi3 promoter (SEQ ID NO: 26), an intein TAL effector fusion (SEQ ID NO: 55), and a Nos terminator (SEQ ID NO: 33). The intein TAL effector fusion (SEQ ID NO: 55) encodes a right TALE N-terminal (SEQ ID NO: 56), CsPDS (T02-R1) binding domain (SEQ ID NO: 57), right TALE C-terminal (SEQ ID NO: 58), a linker (SEQ ID NO: 59), and Gp41-1 int-N peptide sequence (SEQ ID NO: 60). The FokI cassette (SEQ ID NO: 61) encodes an MtEFla promoter (SEQ ID NO: 42), an intein FokI fusion (SEQ ID NO: 62), and a Nos terminator (SEQ ID NO: 33). The intein FokI fusion (SEQ ID NO: 62) encodes a nuclear localization signal (SEQ ID NO: 63), a Gp41-1 int-C peptide sequence (SEQ ID NO: 64), a linker (AGCCGTTCC), and FokI (SEQ ID NO: 19).

A sequence of plasmid vector 65 is set forth in SEQ ID NO: 65, which encodes an YFP cassette (SEQ ID NO: 21), a left half TALE cassette (SEQ ID NO: 66), a right half TALE cassette (SEQ ID NO: 74), and a FokI cassette (SEQ ID NO: 82). The YFP cassette encodes a FMV promoter (SEQ ID NO: 22), an YFP protein (SEQ ID NO: 23), and an Rbcs terminator (SEQ ID NO: 24). The left half TALE cassette (SEQ ID NO: 66) encodes a VaUbi3 promoter (SEQ ID NO: 26), an intein TAL effector fusion (SEQ ID NO: 67), and a Nos terminator (SEQ ID NO: 33). The intein TAL effector fusion (SEQ ID NO: 67) encodes a left TALE N-terminal (SEQ ID NO: 68), CsTHCAS (T22-L1) binding domain (SEQ ID NO: 69), left TALE C-terminal (SEQ ID NO: 70), a linker (SEQ ID NO: 71), a native splice site int-N(SEQ ID NO: 72), and Gp41-1 int-N peptide sequence (SEQ ID NO: 73). The right half TALE cassette (SEQ ID NO: 74) encodes a VaUbi3 promoter (SEQ ID NO: 26), an intein TAL effector fusion (SEQ ID NO: 75), and a Nos terminator (SEQ ID NO: 33). The intein TAL effector fusion (SEQ ID NO: 75) encodes a right TALE N-terminal (SEQ ID NO: 76), CsTHCAS (T22-R1) binding domain (SEQ ID NO: 77), right TALE C-terminal (SEQ ID NO: 78), a linker (SEQ ID NO: 79), a native splice site int-N(SEQ ID NO: 80), and Gp41-1 int-N peptide sequence (SEQ ID NO: 81). The FokI cassette (SEQ ID NO: 82) encodes a MtEFla promoter (SEQ ID NO: 42), an intein FokI fusion (SEQ ID NO: 83), and a Nos terminator (SEQ ID NO: 33). The intein FokI fusion (SEQ ID NO: 83) encodes a nuclear localization signal (SEQ ID NO: 84), an Gp41-1 int-C peptide sequence (SEQ ID NO: 85), a native splice site int-C (SEQ ID NO: 86), a linker (AGCCGTTCC), and FokI (SEQ ID NO: 19).

The remaining example constructs are described below. Plasmid vector 87 (set forth in SEQ ID NO: 87) encodes for left and right TALE effectors that are targeted to THCAS, along with a FokI cassette which each include Ssp DnaE inteins, native. Plasmid vector 88 (set forth in SEQ ID NO: 88) encodes for left and right TALE effectors that are targeted to THCAS, along with a FokI cassette which each include Gp41-1 inteins, non-native. Plasmid vector 89 (set forth in SEQ ID NO: 89) encodes for left and right TALE effectors that are targeted to THCAS, along with a FokI cassette which each include Gp41-1 inteins, native. Plasmid vector 90 (set forth in SEQ ID NO: 90) is a control TALEN vector that encodes a left and right half TALENs targeted to the THCAS gene. Plasmid vector 91 (set forth in SEQ ID NO: 91) is a control TALEN vector that encodes a left and right half TALENs targeted to the PDS gene.

Figure 8A:
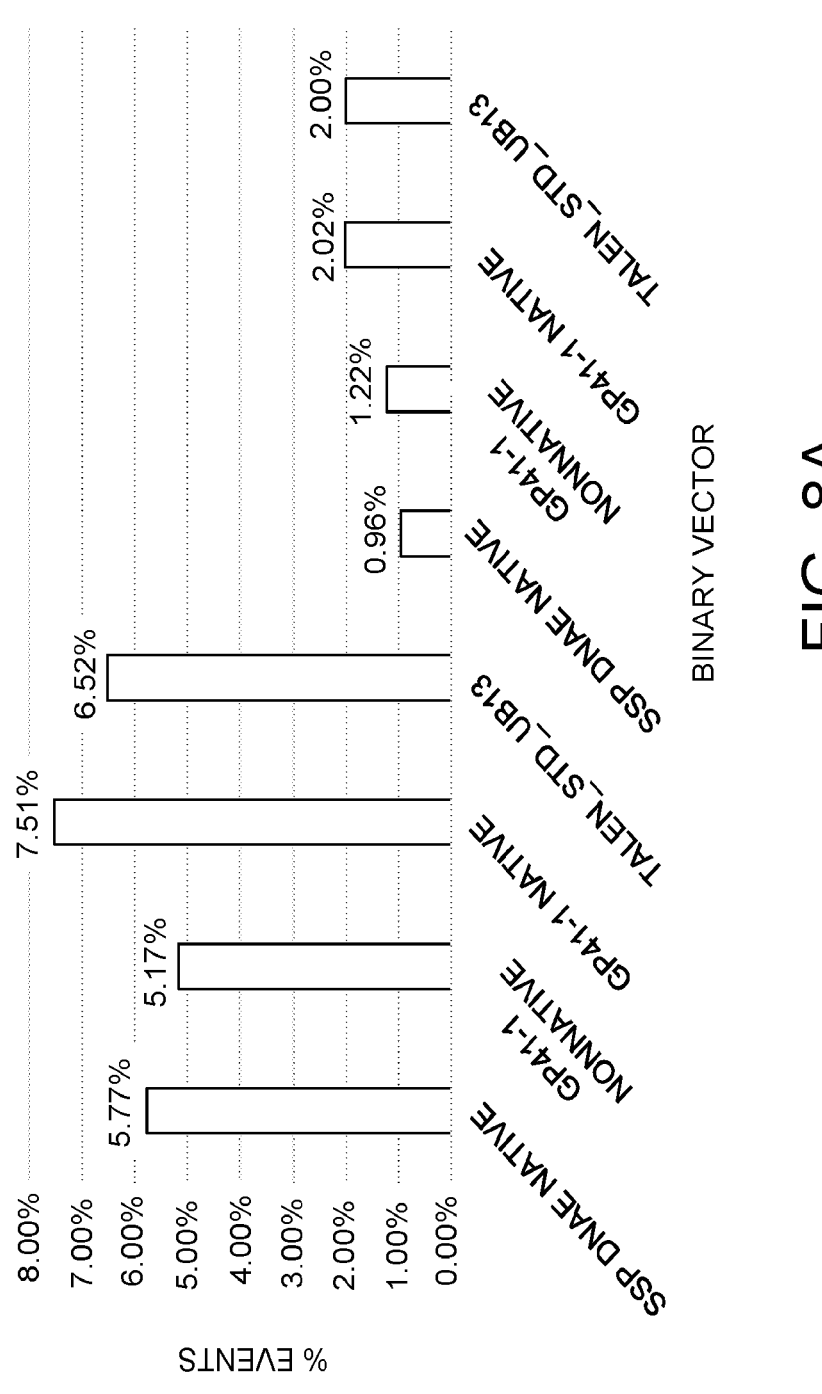
FIGS. 8A-8I illustrate results of transforming hemp explants using the different plasmid vectors, consistent with the present disclosure.

FIGS. 8A-8I illustrate results of transforming hemp explants using the different plasmid vectors, consistent with the present disclosure. FIG. 8A is a graph comparing the editing efficiencies of different plasmid vectors of the first set and second set, illustrating the editing efficiencies of no inteins (e.g., plasmid vectors 90 and 91), inteins of SSP DnaE and native exteins (e.g., plasmid vectors 20 and 87), inteins of GP41-1 and non-native exteins (e.g., plasmid vectors 46 and 88), and inteins of GP41-1 and native exteins (e.g., plasmid vectors 89 and 65).

Figure 8B:
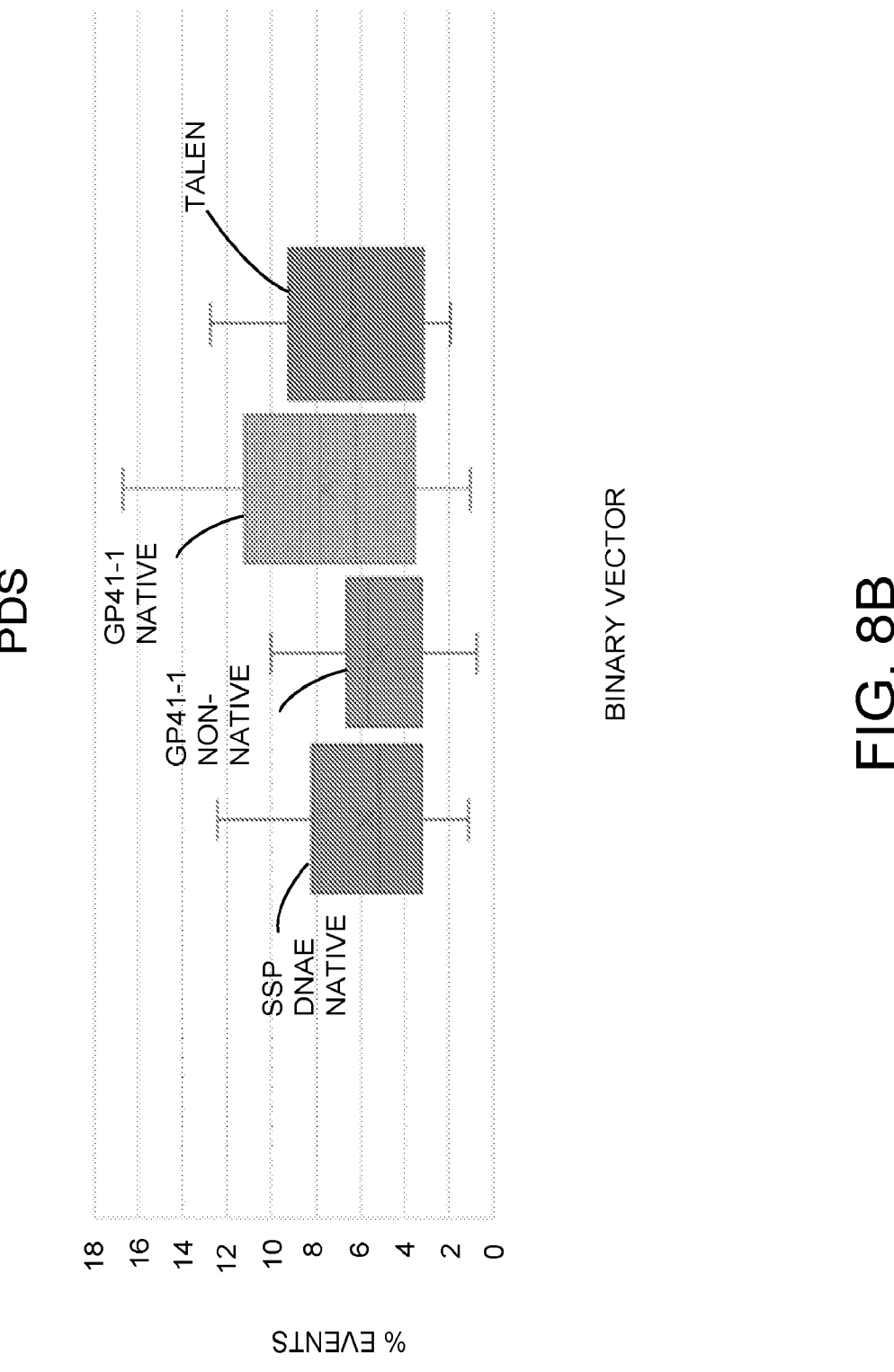
Figure 8C:
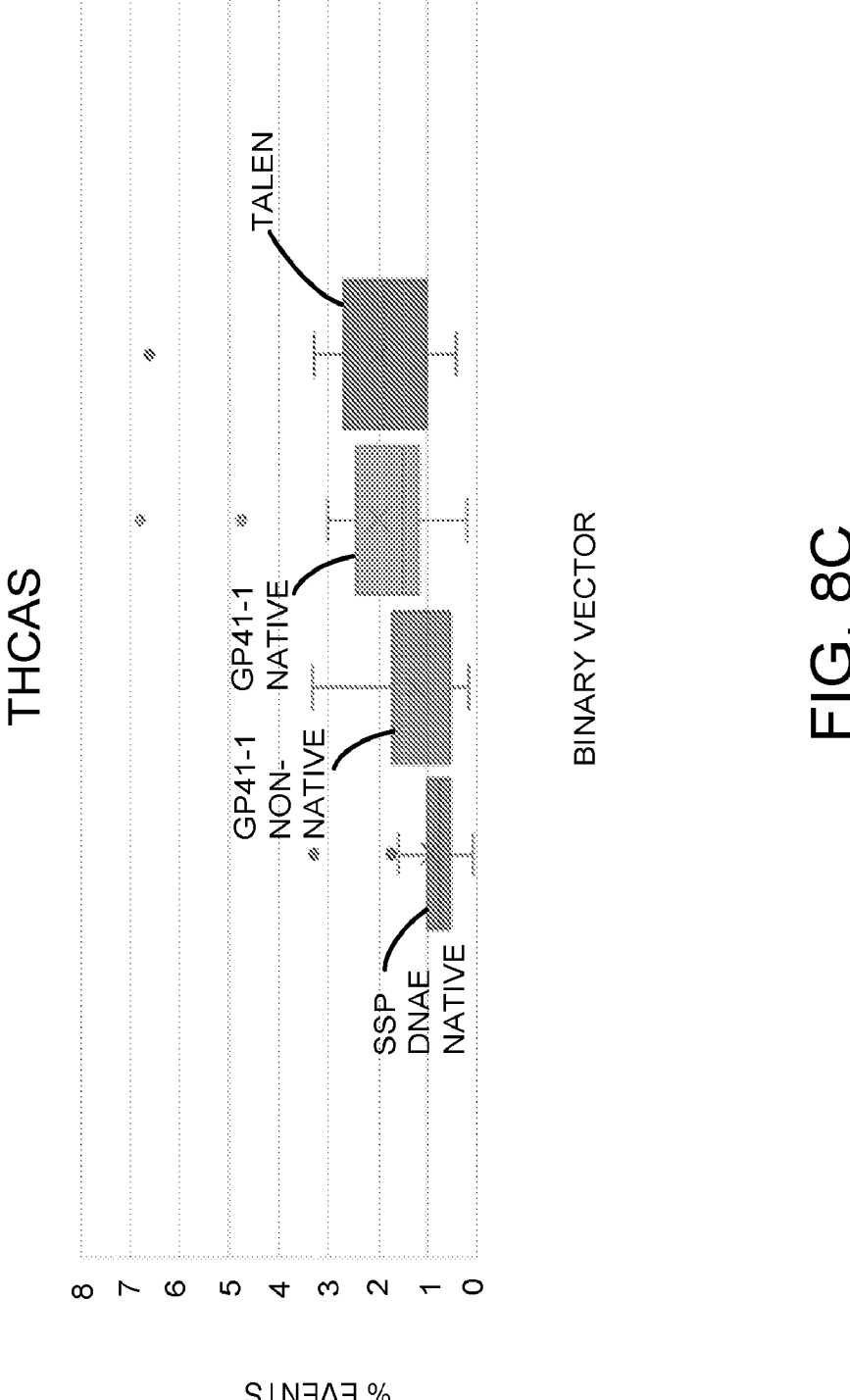
Figure 8D:
Figure 8E:
Figure 8F:
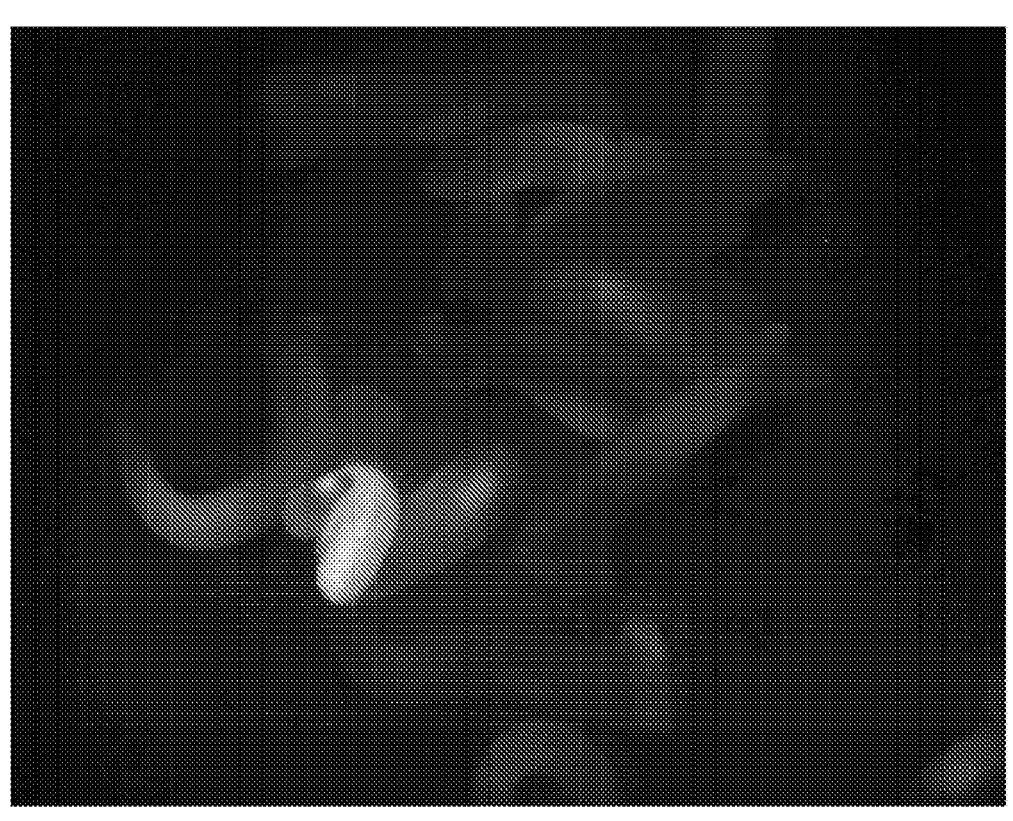
Figure 8G:
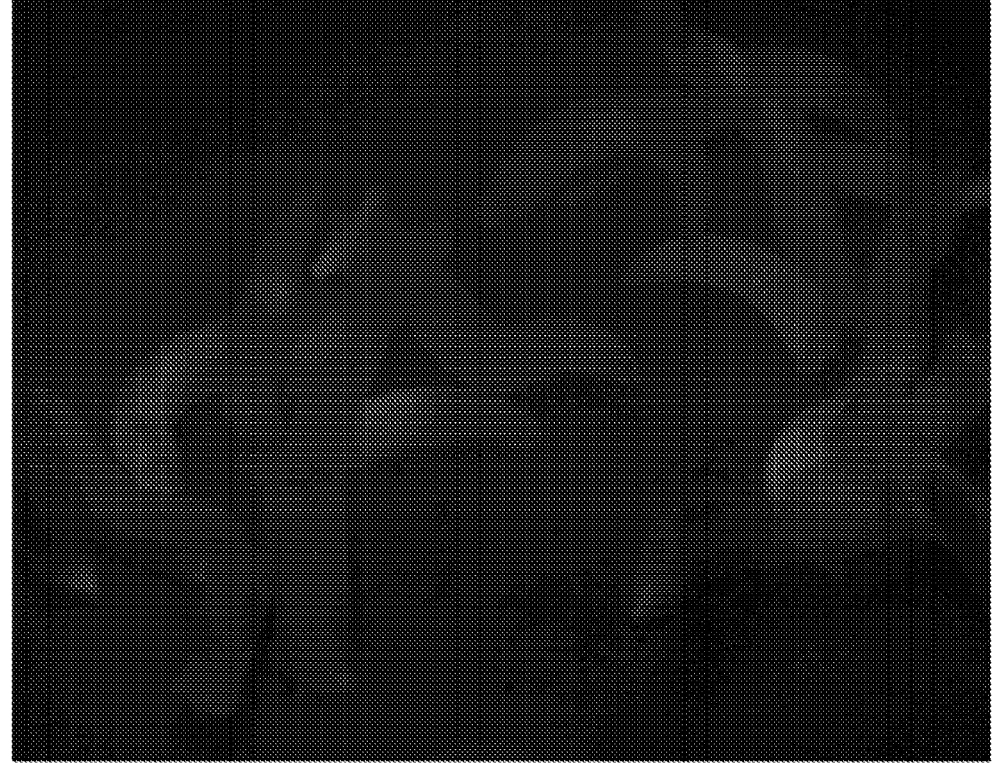
Figure 8H:
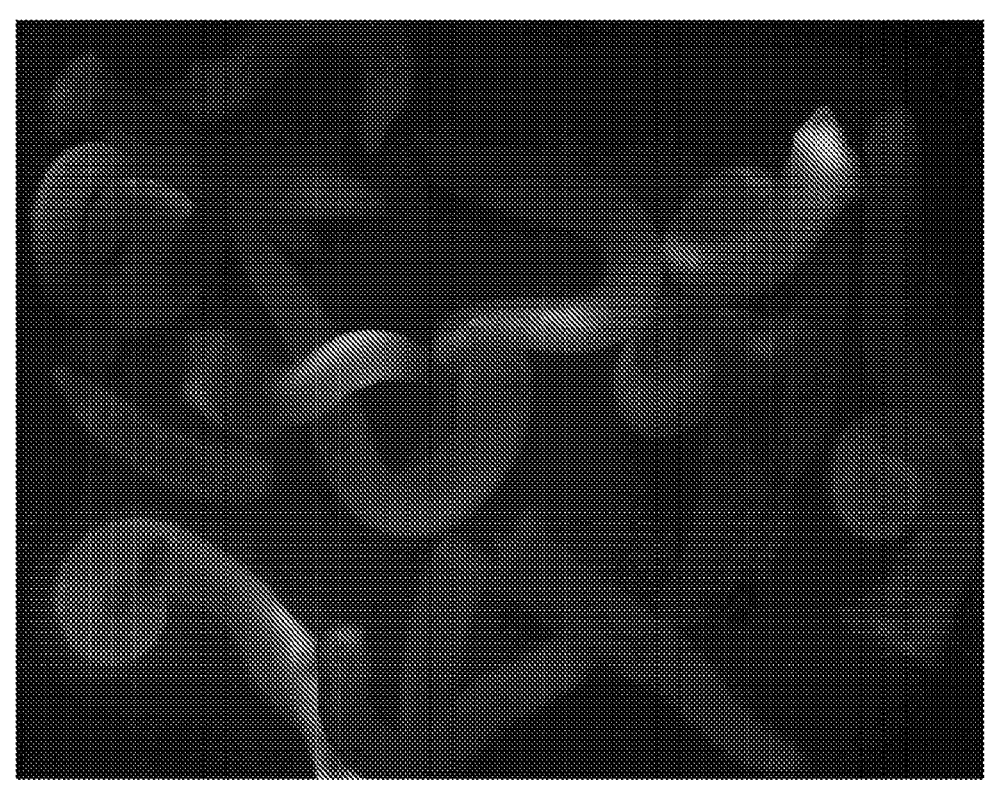
Figure 8I:
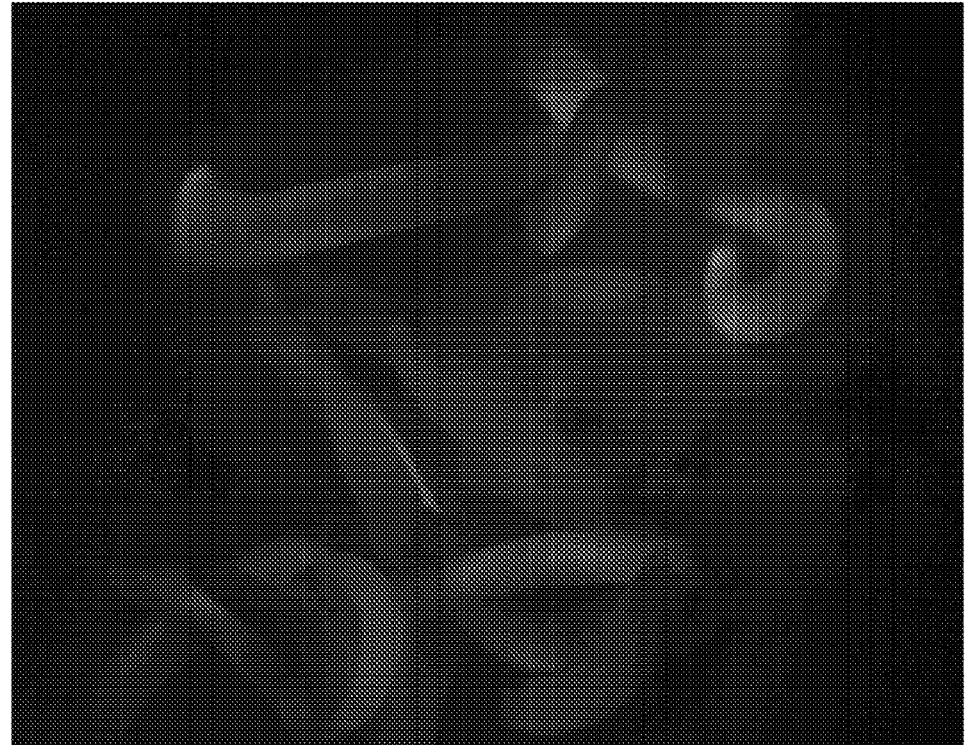

FIGS. 8B-8C are graph comparing the percent editing events of the different plasmid vectors of the first set and second set, as illustrated by FIG. 8A. FIGS. 8D-8I are images of explants from experiments assessing the transformation of the explants with the different plasmid vectors of plasmid vector 20 (FIG. 8D), plasmid vector 46 (FIG. 8E), plasmid vector 89 (FIG. 8F), plasmid vector 87 (FIG. 8G), plasmid vector 88 (FIG. 8H) and plasmid vector 65 (FIG. 8I), consistent with the present disclosure.

SEQUENCE LISTING (159 sequences)

SEQ ID NO: 1 - DNA, 5903 bp, synthetic construct
  misc_feature 1..5903: note = Synthetic
  source 1..5903: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 2 - DNA, 307 bp, synthetic construct
  misc_feature 1..307: note = Synthetic
  source 1..307: mol_type = other DNA
gatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatct

SEQ ID NO: 3 - DNA, 480 bp, synthetic construct
  misc_feature 1..480: note = Synthetic
  source 1..480: mol_type = other DNA
atgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaac

SEQ ID NO: 4 - DNA, 1530 bp, synthetic construct
  misc_feature 1..1530: note = Synthetic
  source 1..1530: mol_type = other DNA
ttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggc

SEQ ID NO: 5 - DNA, 177 bp, synthetic construct
  misc_feature 1..177: note = Synthetic
  source 1..177: mol_type = other DNA
ttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaaggga

SEQ ID NO: 6 - DNA, 15 bp, synthetic construct
  misc_feature 1..15: note = Synthetic
  source 1..15: mol_type = other DNA
ttgggggatcctatc

SEQ ID NO: 7 - DNA, 369 bp, synthetic construct
  misc_feature 1..369: note = Synthetic
  source 1..369: mol_type = other DNA
tgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaag

SEQ ID NO: 8 - DNA, 279 bp, synthetic construct
  misc_feature 1..279: note = Synthetic
  source 1..279: mol_type = other DNA
cgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagc

SEQ ID NO: 9 - DNA, 5924 bp, synthetic construct
  misc_feature 1..5924: note = Synthetic
  source 1..5924: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 10 - DNA, 498 bp, synthetic construct
  misc_feature 1..498: note = Synthetic
  source 1..498: mol_type = other DNA
atgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaac

SEQ ID NO: 11 - DNA, 1530 bp, synthetic construct
  misc_feature 1..1530: note = Synthetic
  source 1..1530: mol_type = other DNA
ttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggc

SEQ ID NO: 12 - DNA, 177 bp, synthetic construct; identical to SEQ ID NO: 5
  misc_feature 1..177: note = Synthetic
  source 1..177: mol_type = other DNA

SEQ ID NO: 13 - DNA, 4828 bp, synthetic construct
  misc_feature 1..4828: note = Synthetic
  source 1..4828: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccagagaccggcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccaccggtggtctcacctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 14 - DNA, 398 bp, synthetic construct
  misc_feature 1..398: note = Synthetic
  source 1..398: mol_type = other DNA
ccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgc

SEQ ID NO: 15 - DNA, 4849 bp, synthetic construct
  misc_feature 1..4849: note = Synthetic
  source 1..4849: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccagagaccggcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccaccggtggtctcacctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 16 - DNA, 398 bp, synthetic construct; identical to SEQ ID NO: 14
  misc_feature 1..398: note = Synthetic
  source 1..398: mol_type = other DNA

SEQ ID NO: 17 - DNA, 4097 bp, synthetic construct
  misc_feature 1..4097: note = Synthetic
  source 1..4097: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgtcgaatacatctagatccaagtacatggattgatcggaatcgagattgcctcggtacaagcaagcgcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatggatcctaaaaagaaacgtaaggtcatggtgaaggttattggaaggagatctcttggtgtgcaaaggattttcgatattggacttccacaagatcacaacttccttttggctaacggagcaattgctgctaacagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacctagaccaagacttcagctcgcgtcgtcggaatcgagattgcctcggtacaagaacgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 18 - DNA, 108 bp, synthetic construct
  misc_feature 1..108: note = Synthetic
  source 1..108: mol_type = other DNA
atggtgaaggttattggaaggagatctcttggtgtgcaaaggattttcgatattggacttccacaagatcacaacttccttttggctaacggagcaattgctgctaac

SEQ ID NO: 19 - DNA, 603 bp, synthetic construct
  misc_feature 1..603: note = Synthetic
  source 1..603: mol_type = other DNA
cagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 20 - DNA, 20597 bp, synthetic construct
  misc_feature 1..20597: note = Synthetic
  source 1..20597: mol_type = other DNA
gcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgagctggtctcagttacaatttgagtgttttactcctcatattaacttcggtcattagaggccacgatttgacacatttttactcaaaacaaaatgtttgcatatctcttataatttcaaattcaacacacaacaaataagagaaaaaacaaataatattaatttgagaatgaacaaaaggaccatatcattcattaactcttctccatccatttccatttcacagttcgatagcgaaaaccgaataaaaaacacagtaaattacaagcacaacaaatggtacaagaaaaacagttttcccaatgccataatactcgaaccctagtctttaaaggtcacccgggaaccgcggcttgtacagctcgtccatgccgagagtgatcccggcggcggtcacgaactccagcaggaccatgtgatcgcgcttctcgttggggtctttgctcagggcggactggtagctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcgggcgaagcactgcaggccgtagccgaaggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccattgttataacctttctcttcttcttaggagccatggtggtgtgcgatcgcgagaaatattggttagtatctgatgatccttcaaatgggaatgaatgccttcttatatagagggaattcttttgtggtcgtcactgcgttcgtcatacgcattagtgagtgggctgtcaggacagctcttttccacgttattttgttccccacttgtactagaggaatctgctttatctttgcaataaaggcaaagatgcttttggtaggtgcgcctaacaattctgcaccattccttttttgtctggtccccacaagccagctgctcgatgttgacaagattactttcaaagatgcccactaactttaagtcttcggtggatgtctttttctgaaacttactgaccatgatgcatgtgctggaacagtagtttactttgattgaagattcttcattgatctcctgtagcttttggctaatggtttggagactctgtaccctgaccttgttgaggctttggactgagaattcttccttacaaacctttgaggatgggagttccttcttggttttggcgataccaatttgaataaagtgatatggctcgtaccttgttgattgaacccaatctggaatgctgctaaatattttgatgataacaacgttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaggagttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaccagttacgcaaccttcgtgccacatcgagtattcaacagacacataagctttttgtttttctaacaaaatatggttaaaaaaacaacaatgtaaatgtttacaaacttaaatgactaaattgttattaaaaaaaaacttggggaaatgttaaaaaacgcatttaggacacttgctaaagacttattttttaaaaaacctgtcataaaaagtggtgtattcaatcttactcaactttttgaaagttcgaaatttgttatttccaataccaaattttcatttttccttttcttaactaacatccttggatctcactcgttagcgtgacttagactcttacaacattatcttgtcatacacctctagctttaatgacatcacaattagcatgacctaaaaacttaccggactaacttttttcgaaatgaattgacattgtatgtcggacattatgacctatttgacattatatgtctattaattaataattttttgaagaagaaaccttcatgtttggttttgcccaatatttcacttgggccacactcaaagaaaagcccaaaaaaacaatgtcacagacattacaaacctaaatgaaacgatgtcgtcacaataccttaacctaaccttctttcttattccatccttacctaaaaaactcacaaaagcatattccatccgccactctccaacgttcacattagggtattttcggaaatccaaaattcagcaaggacacttttggaacataaaaatatctgggaccctataaaaacattgtaaccctaggttttttcattctcactcatttctttcactctcaaatatcactccgtctctctctgcggctgagagttcccaaccctagatttcgattcagctgaggtaacaacaatctccgattcttgtttcattgattcgatctatgtttctttgttgttcaattacatgaattaaatgaatctgtttcataattttgttcggttaatttgcatgttttgattttgtttattgtttgagaaatttaatcatgaatgaatcgatttatgattgtaatattggatattgaatttgtttgagctaaattttgtatgagaaattttaattttgaatttaatctgattctgtttattgtttgagaaattttaattatgaatcgatatgattttgtaatatttgattaattctagctaatttaaccgattgttaatctgaaattatagatctgtgtattttgttgttgaaatgatttaattttgtttgaaaagttatgagtttttgatgtttttattgtttaattatggatctgttaatacagtactgtgattttaatttggtttcgtttatttaattaaaatggtcttcaaatttgagctgtgtttgtttgttgatgtgaaaatgtaatttttttgtatctaataacatgagtctggtttatcatgtttcataattggatctagattatgtatgttgaaagtctgttctgaattttgattaacaagtacttttttgttattctgatttattgattacttttggggtatgactcttgtgttgttggatttggtttgatgagatcttgtgtggttaagttgattttaaatttcatgttaatattgataagctgagttggattattgcttgtctgtttcacttattatcatttagcttattacacaatgaattagttgtttggttaagcatgatttgtttattacaatgaaataatttacgaattagcatgataatgacttttgaaactgtcaaatgcggttcaattattttagtgaacatgattcagaagttttgaaactttgcatggattttcatttgttatggttttttactgttgatttctgacttttgtagtttttatgaattgcaggtaagacaaccacaccaccatggatcctaaaaagaaacgtaaggtcatggtgaaggttattggaaggagatctcttggtgtgcaaaggattttcgatattggacttccacaagatcacaacttccttttggctaacggagcaattgctgctaactgcttcaacagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaactcactgagagacccgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagcccaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggccctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaacc

SEQ ID NO: 21 - DNA, 1529 bp, synthetic construct
  misc_feature 1..1529: note = Synthetic
  source 1..1529: mol_type = other DNA
tcatcaaaatatttagcagcattccagattgggttcaatcaacaaggtacgagccatatcactttattcaaattggtatcgccaaaaccaagaaggaactcccatcctcaaaggtttgtaaggaagaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattccctctatataagaaggcattcattcccatttgaaggatcatcagatactaaccaatatttctcatggctcctaagaagaagagaaaggttataacaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagccgcggttcccgggtgacctttaaccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacact

SEQ ID NO: 22 - DNA, 597 bp, synthetic construct
  misc_feature 1..597: note = Synthetic
  source 1..597: mol_type = other DNA
tcatcaaaatatttagcagcattccagattgggttcaatcaacaaggtacgagccatatcactttattcaaattggtatcgccaaaaccaagaaggaactcccatcctcaaaggtttgtaaggaagaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattccctctatataagaaggcattcattcccatttgaaggatcatcagatactaaccaatatttctc

SEQ ID NO: 23 - DNA, 774 bp, synthetic construct
  misc_feature 1..774: note = Synthetic
  source 1..774: mol_type = other DNA
atggctcctaagaagaagagaaaggttataacaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagccgcggttcccgggtgacctttaa

SEQ ID NO: 24 - DNA, 158 bp, synthetic construct
  misc_feature 1..158: note = Synthetic
  source 1..158: mol_type = other DNA
ccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacact

SEQ ID NO: 25 - DNA, 4683 bp, synthetic construct
  misc_feature 1..4683: note = Synthetic
  source 1..4683: mol_type = other DNA
gtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagc

SEQ ID NO: 26 - DNA, 1815 bp, synthetic construct
  misc_feature 1..1815: note = Synthetic
  source 1..1815: mol_type = other DNA
gtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggt

SEQ ID NO: 27 - DNA, 2589 bp, synthetic construct
  misc_feature 1..2589: note = Synthetic
  source 1..2589: mol_type = other DNA
atgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggc

SEQ ID NO: 28 - DNA, 482 bp, synthetic construct
  misc_feature 1..482: note = Synthetic
  source 1..482: mol_type = other DNA
atgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaactt

SEQ ID NO: 29 - DNA, 1540 bp, synthetic construct
  misc_feature 1..1540: note = Synthetic
  source 1..1540: mol_type = other DNA
ttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctc

SEQ ID NO: 30 - DNA, 172 bp, synthetic construct
  misc_feature 1..172: note = Synthetic
  source 1..172: mol_type = other DNA
tcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattg

SEQ ID NO: 31 - DNA, 12 bp, synthetic construct
  misc_feature 1..12: note = Synthetic
  source 1..12: mol_type = other DNA
ggggatcctatc

SEQ ID NO: 32 - DNA, 369 bp, synthetic construct; identical to SEQ ID NO: 7
  misc_feature 1..369: note = Synthetic
  source 1..369: mol_type = other DNA

SEQ ID NO: 33 - DNA, 279 bp, synthetic construct; identical to SEQ ID NO: 8
  misc_feature 1..279: note = Synthetic
  source 1..279: mol_type = other DNA

SEQ ID NO: 34 - DNA, 4683 bp, synthetic construct; identical to SEQ ID NO: 25
  misc_feature 1..4683: note = Synthetic
  source 1..4683: mol_type = other DNA

SEQ ID NO: 35 - DNA, 2589 bp, synthetic construct; identical to SEQ ID NO: 27
  misc_feature 1..2589: note = Synthetic
  source 1..2589: mol_type = other DNA

SEQ ID NO: 36 - DNA, 500 bp, synthetic construct
  misc_feature 1..500: note = Synthetic
  source 1..500: mol_type = other DNA
atgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaactt

SEQ ID NO: 37 - DNA, 1540 bp, synthetic construct
  misc_feature 1..1540: note = Synthetic
  source 1..1540: mol_type = other DNA
ttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctc

SEQ ID NO: 38 - DNA, 172 bp, synthetic construct; identical to SEQ ID NO: 30
  misc_feature 1..172: note = Synthetic
  source 1..172: mol_type = other DNA

SEQ ID NO: 39 - DNA, 12 bp, synthetic construct
  misc_feature 1..12: note = Synthetic
  source 1..12: mol_type = other DNA
ggggatcctatc

SEQ ID NO: 40 - DNA, 369 bp, synthetic construct; identical to SEQ ID NO: 7
  misc_feature 1..369: note = Synthetic
  source 1..369: mol_type = other DNA

SEQ ID NO: 41 - DNA, 2922 bp, synthetic construct
  misc_feature 1..2922: note = Synthetic
  source 1..2922: mol_type = other DNA
cgcaaccttcgtgccacatcgagtattcaacagacacataagctttttgtttttctaacaaaatatggttaaaaaaacaacaatgtaaatgtttacaaacttaaatgactaaattgttattaaaaaaaaacttggggaaatgttaaaaaacgcatttaggacacttgctaaagacttattttttaaaaaacctgtcataaaaagtggtgtattcaatcttactcaactttttgaaagttcgaaatttgttatttccaataccaaattttcatttttccttttcttaactaacatccttggatctcactcgttagcgtgacttagactcttacaacattatcttgtcatacacctctagctttaatgacatcacaattagcatgacctaaaaacttaccggactaacttttttcgaaatgaattgacattgtatgtcggacattatgacctatttgacattatatgtctattaattaataattttttgaagaagaaaccttcatgtttggttttgcccaatatttcacttgggccacactcaaagaaaagcccaaaaaaacaatgtcacagacattacaaacctaaatgaaacgatgtcgtcacaataccttaacctaaccttctttcttattccatccttacctaaaaaactcacaaaagcatattccatccgccactctccaacgttcacattagggtattttcggaaatccaaaattcagcaaggacacttttggaacataaaaatatctgggaccctataaaaacattgtaaccctaggttttttcattctcactcatttctttcactctcaaatatcactccgtctctctctgcggctgagagttcccaaccctagatttcgattcagctgaggtaacaacaatctccgattcttgtttcattgattcgatctatgtttctttgttgttcaattacatgaattaaatgaatctgtttcataattttgttcggttaatttgcatgttttgattttgtttattgtttgagaaatttaatcatgaatgaatcgatttatgattgtaatattggatattgaatttgtttgagctaaattttgtatgagaaattttaattttgaatttaatctgattctgtttattgtttgagaaattttaattatgaatcgatatgattttgtaatatttgattaattctagctaatttaaccgattgttaatctgaaattatagatctgtgtattttgttgttgaaatgatttaattttgtttgaaaagttatgagtttttgatgtttttattgtttaattatggatctgttaatacagtactgtgattttaatttggtttcgtttatttaattaaaatggtcttcaaatttgagctgtgtttgtttgttgatgtgaaaatgtaatttttttgtatctaataacatgagtctggtttatcatgtttcataattggatctagattatgtatgttgaaagtctgttctgaattttgattaacaagtacttttttgttattctgatttattgattacttttggggtatgactcttgtgttgttggatttggtttgatgagatcttgtgtggttaagttgattttaaatttcatgttaatattgataagctgagttggattattgcttgtctgtttcacttattatcatttagcttattacacaatgaattagttgtttggttaagcatgatttgtttattacaatgaaataatttacgaattagcatgataatgacttttgaaactgtcaaatgcggttcaattattttagtgaacatgattcagaagttttgaaactttgcatggattttcatttgttatggttttttactgttgatttctgacttttgtagtttttatgaattgcaggtaagacaacatggatcctaaaaagaaacgtaaggtcatggtgaaggttattggaaggagatctcttggtgtgcaaaggattttcgatattggacttccacaagatcacaacttccttttggctaacggagcaattgctgctaactgcttcaacagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataacgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagc

SEQ ID NO: 42 - DNA, 1887 bp, synthetic construct
  misc_feature 1..1887: note = Synthetic
  source 1..1887: mol_type = other DNA
cgcaaccttcgtgccacatcgagtattcaacagacacataagctttttgtttttctaacaaaatatggttaaaaaaacaacaatgtaaatgtttacaaacttaaatgactaaattgttattaaaaaaaaacttggggaaatgttaaaaaacgcatttaggacacttgctaaagacttattttttaaaaaacctgtcataaaaagtggtgtattcaatcttactcaactttttgaaagttcgaaatttgttatttccaataccaaattttcatttttccttttcttaactaacatccttggatctcactcgttagcgtgacttagactcttacaacattatcttgtcatacacctctagctttaatgacatcacaattagcatgacctaaaaacttaccggactaacttttttcgaaatgaattgacattgtatgtcggacattatgacctatttgacattatatgtctattaattaataattttttgaagaagaaaccttcatgtttggttttgcccaatatttcacttgggccacactcaaagaaaagcccaaaaaaacaatgtcacagacattacaaacctaaatgaaacgatgtcgtcacaataccttaacctaaccttctttcttattccatccttacctaaaaaactcacaaaagcatattccatccgccactctccaacgttcacattagggtattttcggaaatccaaaattcagcaaggacacttttggaacataaaaatatctgggaccctataaaaacattgtaaccctaggttttttcattctcactcatttctttcactctcaaatatcactccgtctctctctgcggctgagagttcccaaccctagatttcgattcagctgaggtaacaacaatctccgattcttgtttcattgattcgatctatgtttctttgttgttcaattacatgaattaaatgaatctgtttcataattttgttcggttaatttgcatgttttgattttgtttattgtttgagaaatttaatcatgaatgaatcgatttatgattgtaatattggatattgaatttgtttgagctaaattttgtatgagaaattttaattttgaatttaatctgattctgtttattgtttgagaaattttaattatgaatcgatatgattttgtaatatttgattaattctagctaatttaaccgattgttaatctgaaattatagatctgtgtattttgttgttgaaatgatttaattttgtttgaaaagttatgagtttttgatgtttttattgtttaattatggatctgttaatacagtactgtgattttaatttggtttcgtttatttaattaaaatggtcttcaaatttgagctgtgtttgtttgttgatgtgaaaatgtaatttttttgtatctaataacatgagtctggtttatcatgtttcataattggatctagattatgtatgttgaaagtctgttctgaattttgattaacaagtacttttttgttattctgatttattgattacttttggggtatgactcttgtgttgttggatttggtttgatgagatcttgtgtggttaagttgattttaaatttcatgttaatattgataagctgagttggattattgcttgtctgtttcacttattatcatttagcttattacacaatgaattagttgtttggttaagcatgatttgtttattacaatgaaataatttacgaattagcatgataatgacttttgaaactgtcaaatgcggttcaattattttagtgaacatgattcagaagttttgaaactttgcatggattttcatttgttatggttttttactgttgatttctgacttttgtagtttttatgaattgcaggtaagacaac

SEQ ID NO: 43 - DNA, 756 bp, synthetic construct
  misc_feature 1..756: note = Synthetic
  source 1..756: mol_type = other DNA
atggatcctaaaaagaaacgtaaggtcatggtgaaggttattggaaggagatctcttggtgtgcaaaggattttcgatattggacttccacaagatcacaacttccttttggctaacggagcaattgctgctaactgcttcaacagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 44 - DNA, 24 bp, synthetic construct
  misc_feature 1..24: note = Synthetic
  source 1..24: mol_type = other DNA
gatcctaaaaagaaacgtaaggtc

SEQ ID NO: 45 - DNA, 108 bp, synthetic construct; identical to SEQ ID NO: 18
  misc_feature 1..108: note = Synthetic
  source 1..108: mol_type = other DNA

SEQ ID NO: 46 - DNA, 20381 bp, synthetic construct
  misc_feature 1..20381: note = Synthetic
  source 1..20381: mol_type = other DNA
gcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgagctggtctcagttacaatttgagtgttttactcctcatattaacttcggtcattagaggccacgatttgacacatttttactcaaaacaaaatgtttgcatatctcttataatttcaaattcaacacacaacaaataagagaaaaaacaaataatattaatttgagaatgaacaaaaggaccatatcattcattaactcttctccatccatttccatttcacagttcgatagcgaaaaccgaataaaaaacacagtaaattacaagcacaacaaatggtacaagaaaaacagttttcccaatgccataatactcgaaccctagtctttaaaggtcacccgggaaccgcggcttgtacagctcgtccatgccgagagtgatcccggcggcggtcacgaactccagcaggaccatgtgatcgcgcttctcgttggggtctttgctcagggcggactggtagctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcgggcgaagcactgcaggccgtagccgaaggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccattgttataacctttctcttcttcttaggagccatggtggtgtgcgatcgcgagaaatattggttagtatctgatgatccttcaaatgggaatgaatgccttcttatatagagggaattcttttgtggtcgtcactgcgttcgtcatacgcattagtgagtgggctgtcaggacagctcttttccacgttattttgttccccacttgtactagaggaatctgctttatctttgcaataaaggcaaagatgcttttggtaggtgcgcctaacaattctgcaccattccttttttgtctggtccccacaagccagctgctcgatgttgacaagattactttcaaagatgcccactaactttaagtcttcggtggatgtctttttctgaaacttactgaccatgatgcatgtgctggaacagtagtttactttgattgaagattcttcattgatctcctgtagcttttggctaatggtttggagactctgtaccctgaccttgttgaggctttggactgagaattcttccttacaaacctttgaggatgggagttccttcttggttttggcgataccaatttgaataaagtgatatggctcgtaccttgttgattgaacccaatctggaatgctgctaaatattttgatgataacaacgttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaggagttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaccagttacgcaaccttcgtgccacatcgagtattcaacagacacataagctttttgtttttctaacaaaatatggttaaaaaaacaacaatgtaaatgtttacaaacttaaatgactaaattgttattaaaaaaaaacttggggaaatgttaaaaaacgcatttaggacacttgctaaagacttattttttaaaaaacctgtcataaaaagtggtgtattcaatcttactcaactttttgaaagttcgaaatttgttatttccaataccaaattttcatttttccttttcttaactaacatccttggatctcactcgttagcgtgacttagactcttacaacattatcttgtcatacacctctagctttaatgacatcacaattagcatgacctaaaaacttaccggactaacttttttcgaaatgaattgacattgtatgtcggacattatgacctatttgacattatatgtctattaattaataattttttgaagaagaaaccttcatgtttggttttgcccaatatttcacttgggccacactcaaagaaaagcccaaaaaaacaatgtcacagacattacaaacctaaatgaaacgatgtcgtcacaataccttaacctaaccttctttcttattccatccttacctaaaaaactcacaaaagcatattccatccgccactctccaacgttcacattagggtattttcggaaatccaaaattcagcaaggacacttttggaacataaaaatatctgggaccctataaaaacattgtaaccctaggttttttcattctcactcatttctttcactctcaaatatcactccgtctctctctgcggctgagagttcccaaccctagatttcgattcagctgaggtaacaacaatctccgattcttgtttcattgattcgatctatgtttctttgttgttcaattacatgaattaaatgaatctgtttcataattttgttcggttaatttgcatgttttgattttgtttattgtttgagaaatttaatcatgaatgaatcgatttatgattgtaatattggatattgaatttgtttgagctaaattttgtatgagaaattttaattttgaatttaatctgattctgtttattgtttgagaaattttaattatgaatcgatatgattttgtaatatttgattaattctagctaatttaaccgattgttaatctgaaattatagatctgtgtattttgttgttgaaatgatttaattttgtttgaaaagttatgagtttttgatgtttttattgtttaattatggatctgttaatacagtactgtgattttaatttggtttcgtttatttaattaaaatggtcttcaaatttgagctgtgtttgtttgttgatgtgaaaatgtaatttttttgtatctaataacatgagtctggtttatcatgtttcataattggatctagattatgtatgttgaaagtctgttctgaattttgattaacaagtacttttttgttattctgatttattgattacttttggggtatgactcttgtgttgttggatttggtttgatgagatcttgtgtggttaagttgattttaaatttcatgttaatattgataagctgagttggattattgcttgtctgtttcacttattatcatttagcttattacacaatgaattagttgtttggttaagcatgatttgtttattacaatgaaataatttacgaattagcatgataatgacttttgaaactgtcaaatgcggttcaattattttagtgaacatgattcagaagttttgaaactttgcatggattttcatttgttatggttttttactgttgatttctgacttttgtagtttttatgaattgcaggtaagacaaccacaccaccatggatcctaaaaagaaacgtaaggtcatgatgctcaagaagattcttaaaatcgaggaacttgacgaaagggagcttattgacatcgaggtaagtgggaaccacctgttctacgccaacgatatactgacacacaatagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaactcactgagagacccgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagcccaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggccctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaacc

SEQ ID NO: 47 - DNA, 4683 bp, synthetic construct; identical to SEQ ID NO: 25
  misc_feature 1..4683: note = Synthetic
  source 1..4683: mol_type = other DNA

SEQ ID NO: 48 - DNA, 2589 bp, synthetic construct; identical to SEQ ID NO: 27
  misc_feature 1..2589: note = Synthetic
  source 1..2589: mol_type = other DNA

SEQ ID NO: 49 - DNA, 482 bp, synthetic construct; identical to SEQ ID NO: 28
  misc_feature 1..482: note = Synthetic
  source 1..482: mol_type = other DNA

SEQ ID NO: 50 - DNA, 1540 bp, synthetic construct; identical to SEQ ID NO: 29
  misc_feature 1..1540: note = Synthetic
  source 1..1540: mol_type = other DNA

SEQ ID NO: 51 - DNA, 172 bp, synthetic construct; identical to SEQ ID NO: 30
  misc_feature 1..172: note = Synthetic
  source 1..172: mol_type = other DNA

SEQ ID NO: 52 - DNA, 12 bp, synthetic construct
  misc_feature 1..12: note = Synthetic
  source 1..12: mol_type = other DNA
ggggatcctatc

SEQ ID NO: 53 - DNA, 264 bp, synthetic construct
  misc_feature 1..264: note = Synthetic
  source 1..264: mol_type = other DNA
tgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaa

SEQ ID NO: 54 - DNA, 4683 bp, synthetic construct; identical to SEQ ID NO: 25
  misc_feature 1..4683: note = Synthetic
  source 1..4683: mol_type = other DNA

SEQ ID NO: 55 - DNA, 2589 bp, synthetic construct; identical to SEQ ID NO: 27
  misc_feature 1..2589: note = Synthetic
  source 1..2589: mol_type = other DNA

SEQ ID NO: 56 - DNA, 500 bp, synthetic construct; identical to SEQ ID NO: 36
  misc_feature 1..500: note = Synthetic
  source 1..500: mol_type = other DNA

SEQ ID NO: 57 - DNA, 1540 bp, synthetic construct; identical to SEQ ID NO: 37
  misc_feature 1..1540: note = Synthetic
  source 1..1540: mol_type = other DNA

SEQ ID NO: 58 - DNA, 172 bp, synthetic construct; identical to SEQ ID NO: 30
  misc_feature 1..172: note = Synthetic
  source 1..172: mol_type = other DNA

SEQ ID NO: 59 - DNA, 12 bp, synthetic construct
  misc_feature 1..12: note = Synthetic
  source 1..12: mol_type = other DNA
ggggatcctatc

SEQ ID NO: 60 - DNA, 264 bp, synthetic construct; identical to SEQ ID NO: 53
  misc_feature 1..264: note = Synthetic
  source 1..264: mol_type = other DNA

SEQ ID NO: 61 - DNA, 2922 bp, synthetic construct; identical to SEQ ID NO: 41
  misc_feature 1..2922: note = Synthetic
  source 1..2922: mol_type = other DNA

SEQ ID NO: 62 - DNA, 756 bp, synthetic construct; identical to SEQ ID NO: 43
  misc_feature 1..756: note = Synthetic
  source 1..756: mol_type = other DNA

SEQ ID NO: 63 - DNA, 24 bp, synthetic construct
  misc_feature 1..24: note = Synthetic
  source 1..24: mol_type = other DNA
gatcctaaaaagaaacgtaaggtc

SEQ ID NO: 64 - DNA, 111 bp, synthetic construct
  misc_feature 1..111: note = Synthetic
  source 1..111: mol_type = other DNA
atgatgctcaagaagattcttaaaatcgaggaacttgacgaaagggagcttattgacatcgaggtaagtgggaaccacctgttctacgccaacgatatactgacacacaat

SEQ ID NO: 65 - DNA, 20426 bp, synthetic construct
  misc_feature 1..20426: note = Synthetic
  source 1..20426: mol_type = other DNA
gcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgagctggtctcagttacaatttgagtgttttactcctcatattaacttcggtcattagaggccacgatttgacacatttttactcaaaacaaaatgtttgcatatctcttataatttcaaattcaacacacaacaaataagagaaaaaacaaataatattaatttgagaatgaacaaaaggaccatatcattcattaactcttctccatccatttccatttcacagttcgatagcgaaaaccgaataaaaaacacagtaaattacaagcacaacaaatggtacaagaaaaacagttttcccaatgccataatactcgaaccctagtctttaaaggtcacccgggaaccgcggcttgtacagctcgtccatgccgagagtgatcccggcggcggtcacgaactccagcaggaccatgtgatcgcgcttctcgttggggtctttgctcagggcggactggtagctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcgggcgaagcactgcaggccgtagccgaaggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccattgttataacctttctcttcttcttaggagccatggtggtgtgcgatcgcgagaaatattggttagtatctgatgatccttcaaatgggaatgaatgccttcttatatagagggaattcttttgtggtcgtcactgcgttcgtcatacgcattagtgagtgggctgtcaggacagctcttttccacgttattttgttccccacttgtactagaggaatctgctttatctttgcaataaaggcaaagatgcttttggtaggtgcgcctaacaattctgcaccattccttttttgtctggtccccacaagccagctgctcgatgttgacaagattactttcaaagatgcccactaactttaagtcttcggtggatgtctttttctgaaacttactgaccatgatgcatgtgctggaacagtagtttactttgattgaagattcttcattgatctcctgtagcttttggctaatggtttggagactctgtaccctgaccttgttgaggctttggactgagaattcttccttacaaacctttgaggatgggagttccttcttggttttggcgataccaatttgaataaagtgatatggctcgtaccttgttgattgaacccaatctggaatgctgctaaatattttgatgataacaacgttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaggagttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaccagttacgcaaccttcgtgccacatcgagtattcaacagacacataagctttttgtttttctaacaaaatatggttaaaaaaacaacaatgtaaatgtttacaaacttaaatgactaaattgttattaaaaaaaaacttggggaaatgttaaaaaacgcatttaggacacttgctaaagacttattttttaaaaaacctgtcataaaaagtggtgtattcaatcttactcaactttttgaaagttcgaaatttgttatttccaataccaaattttcatttttccttttcttaactaacatccttggatctcactcgttagcgtgacttagactcttacaacattatcttgtcatacacctctagctttaatgacatcacaattagcatgacctaaaaacttaccggactaacttttttcgaaatgaattgacattgtatgtcggacattatgacctatttgacattatatgtctattaattaataattttttgaagaagaaaccttcatgtttggttttgcccaatatttcacttgggccacactcaaagaaaagcccaaaaaaacaatgtcacagacattacaaacctaaatgaaacgatgtcgtcacaataccttaacctaaccttctttcttattccatccttacctaaaaaactcacaaaagcatattccatccgccactctccaacgttcacattagggtattttcggaaatccaaaattcagcaaggacacttttggaacataaaaatatctgggaccctataaaaacattgtaaccctaggttttttcattctcactcatttctttcactctcaaatatcactccgtctctctctgcggctgagagttcccaaccctagatttcgattcagctgaggtaacaacaatctccgattcttgtttcattgattcgatctatgtttctttgttgttcaattacatgaattaaatgaatctgtttcataattttgttcggttaatttgcatgttttgattttgtttattgtttgagaaatttaatcatgaatgaatcgatttatgattgtaatattggatattgaatttgtttgagctaaattttgtatgagaaattttaattttgaatttaatctgattctgtttattgtttgagaaattttaattatgaatcgatatgattttgtaatatttgattaattctagctaatttaaccgattgttaatctgaaattatagatctgtgtattttgttgttgaaatgatttaattttgtttgaaaagttatgagtttttgatgtttttattgtttaattatggatctgttaatacagtactgtgattttaatttggtttcgtttatttaattaaaatggtcttcaaatttgagctgtgtttgtttgttgatgtgaaaatgtaatttttttgtatctaataacatgagtctggtttatcatgtttcataattggatctagattatgtatgttgaaagtctgttctgaattttgattaacaagtacttttttgttattctgatttattgattacttttggggtatgactcttgtgttgttggatttggtttgatgagatcttgtgtggttaagttgattttaaatttcatgttaatattgataagctgagttggattattgcttgtctgtttcacttattatcatttagcttattacacaatgaattagttgtttggttaagcatgatttgtttattacaatgaaataatttacgaattagcatgataatgacttttgaaactgtcaaatgcggttcaattattttagtgaacatgattcagaagttttgaaactttgcatggattttcatttgttatggttttttactgttgatttctgacttttgtagtttttatgaattgcaggtaagacaaccacaccaccatggatcctaaaaagaaacgtaaggtcatgatgctcaagaagattcttaaaatcgaggaacttgacgaaagggagcttattgacatcgaggtaagtgggaaccacctgttctacgccaacgatatactgacacacaatagctcctccgacgttagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaactcactgagagacccgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagcccaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggccctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaacc

SEQ ID NO: 66 - DNA, 4683 bp, synthetic construct; identical to SEQ ID NO: 25
  misc_feature 1..4683: note = Synthetic
  source 1..4683: mol_type = other DNA

SEQ ID NO: 67 - DNA, 2589 bp, synthetic construct; identical to SEQ ID NO: 27
  misc_feature 1..2589: note = Synthetic
  source 1..2589: mol_type = other DNA

SEQ ID NO: 68 - DNA, 482 bp, synthetic construct; identical to SEQ ID NO: 28
  misc_feature 1..482: note = Synthetic
  source 1..482: mol_type = other DNA

SEQ ID NO: 69 - DNA, 1540 bp, synthetic construct
  misc_feature 1..1540: note = Synthetic
  source 1..1540: mol_type = other DNA
ttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctc

SEQ ID NO: 70 - DNA, 172 bp, synthetic construct; identical to SEQ ID NO: 30
  misc_feature 1..172: note = Synthetic
  source 1..172: mol_type = other DNA

SEQ ID NO: 71 - DNA, 12 bp, synthetic construct
  misc_feature 1..12: note = Synthetic
  source 1..12: mol_type = other DNA
ggggatcctatc

SEQ ID NO: 72 - DNA, 15 bp, synthetic construct
  misc_feature 1..15: note = Synthetic
  source 1..15: mol_type = other DNA
accaggagcggatat

SEQ ID NO: 73 - DNA, 264 bp, synthetic construct; identical to SEQ ID NO: 53
  misc_feature 1..264: note = Synthetic
  source 1..264: mol_type = other DNA

SEQ ID NO: 74 - DNA, 4683 bp, synthetic construct; identical to SEQ ID NO: 25
  misc_feature 1..4683: note = Synthetic
  source 1..4683: mol_type = other DNA

SEQ ID NO: 75 - DNA, 2589 bp, synthetic construct; identical to SEQ ID NO: 27
  misc_feature 1..2589: note = Synthetic
  source 1..2589: mol_type = other DNA

SEQ ID NO: 76 - DNA, 500 bp, synthetic construct; identical to SEQ ID NO: 36
  misc_feature 1..500: note = Synthetic
  source 1..500: mol_type = other DNA

SEQ ID NO: 77 - DNA, 1540 bp, synthetic construct
  misc_feature 1..1540: note = Synthetic
  source 1..1540: mol_type = other DNA
ttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctc

SEQ ID NO: 78 - DNA, 172 bp, synthetic construct; identical to SEQ ID NO: 30
  misc_feature 1..172: note = Synthetic
  source 1..172: mol_type = other DNA

SEQ ID NO: 79 - DNA, 12 bp, synthetic construct
  misc_feature 1..12: note = Synthetic
  source 1..12: mol_type = other DNA
ggggatcctatc

SEQ ID NO: 80 - DNA, 15 bp, synthetic construct
  misc_feature 1..15: note = Synthetic
  source 1..15: mol_type = other DNA
accaggagcggatat

SEQ ID NO: 81 - DNA, 264 bp, synthetic construct; identical to SEQ ID NO: 53
  misc_feature 1..264: note = Synthetic
  source 1..264: mol_type = other DNA

SEQ ID NO: 82 - DNA, 2922 bp, synthetic construct; identical to SEQ ID NO: 41
  misc_feature 1..2922: note = Synthetic
  source 1..2922: mol_type = other DNA

SEQ ID NO: 83 - DNA, 756 bp, synthetic construct; identical to SEQ ID NO: 43
  misc_feature 1..756: note = Synthetic
  source 1..756: mol_type = other DNA

SEQ ID NO: 84 - DNA, 24 bp, synthetic construct
  misc_feature 1..24: note = Synthetic
  source 1..24: mol_type = other DNA
gatcctaaaaagaaacgtaaggtc

SEQ ID NO: 85 - DNA, 111 bp, synthetic construct; identical to SEQ ID NO: 64
  misc_feature 1..111: note = Synthetic
  source 1..111: mol_type = other DNA

SEQ ID NO: 86 - DNA, 15 bp, synthetic construct
  misc_feature 1..15: note = Synthetic
  source 1..15: mol_type = other DNA
agctcctccgacgtt

SEQ ID NO: 87 - DNA, 20597 bp, synthetic construct
  misc_feature 1..20597: note = Synthetic
  source 1..20597: mol_type = other DNA
gcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgagctggtctcagttacaatttgagtgttttactcctcatattaacttcggtcattagaggccacgatttgacacatttttactcaaaacaaaatgtttgcatatctcttataatttcaaattcaacacacaacaaataagagaaaaaacaaataatattaatttgagaatgaacaaaaggaccatatcattcattaactcttctccatccatttccatttcacagttcgatagcgaaaaccgaataaaaaacacagtaaattacaagcacaacaaatggtacaagaaaaacagttttcccaatgccataatactcgaaccctagtctttaaaggtcacccgggaaccgcggcttgtacagctcgtccatgccgagagtgatcccggcggcggtcacgaactccagcaggaccatgtgatcgcgcttctcgttggggtctttgctcagggcggactggtagctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcgggcgaagcactgcaggccgtagccgaaggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccattgttataacctttctcttcttcttaggagccatggtggtgtgcgatcgcgagaaatattggttagtatctgatgatccttcaaatgggaatgaatgccttcttatatagagggaattcttttgtggtcgtcactgcgttcgtcatacgcattagtgagtgggctgtcaggacagctcttttccacgttattttgttccccacttgtactagaggaatctgctttatctttgcaataaaggcaaagatgcttttggtaggtgcgcctaacaattctgcaccattccttttttgtctggtccccacaagccagctgctcgatgttgacaagattactttcaaagatgcccactaactttaagtcttcggtggatgtctttttctgaaacttactgaccatgatgcatgtgctggaacagtagtttactttgattgaagattcttcattgatctcctgtagcttttggctaatggtttggagactctgtaccctgaccttgttgaggctttggactgagaattcttccttacaaacctttgaggatgggagttccttcttggttttggcgataccaatttgaataaagtgatatggctcgtaccttgttgattgaacccaatctggaatgctgctaaatattttgatgataacaacgttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaggagttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaccagttacgcaaccttcgtgccacatcgagtattcaacagacacataagctttttgtttttctaacaaaatatggttaaaaaaacaacaatgtaaatgtttacaaacttaaatgactaaattgttattaaaaaaaaacttggggaaatgttaaaaaacgcatttaggacacttgctaaagacttattttttaaaaaacctgtcataaaaagtggtgtattcaatcttactcaactttttgaaagttcgaaatttgttatttccaataccaaattttcatttttccttttcttaactaacatccttggatctcactcgttagcgtgacttagactcttacaacattatcttgtcatacacctctagctttaatgacatcacaattagcatgacctaaaaacttaccggactaacttttttcgaaatgaattgacattgtatgtcggacattatgacctatttgacattatatgtctattaattaataattttttgaagaagaaaccttcatgtttggttttgcccaatatttcacttgggccacactcaaagaaaagcccaaaaaaacaatgtcacagacattacaaacctaaatgaaacgatgtcgtcacaataccttaacctaaccttctttcttattccatccttacctaaaaaactcacaaaagcatattccatccgccactctccaacgttcacattagggtattttcggaaatccaaaattcagcaaggacacttttggaacataaaaatatctgggaccctataaaaacattgtaaccctaggttttttcattctcactcatttctttcactctcaaatatcactccgtctctctctgcggctgagagttcccaaccctagatttcgattcagctgaggtaacaacaatctccgattcttgtttcattgattcgatctatgtttctttgttgttcaattacatgaattaaatgaatctgtttcataattttgttcggttaatttgcatgttttgattttgtttattgtttgagaaatttaatcatgaatgaatcgatttatgattgtaatattggatattgaatttgtttgagctaaattttgtatgagaaattttaattttgaatttaatctgattctgtttattgtttgagaaattttaattatgaatcgatatgattttgtaatatttgattaattctagctaatttaaccgattgttaatctgaaattatagatctgtgtattttgttgttgaaatgatttaattttgtttgaaaagttatgagtttttgatgtttttattgtttaattatggatctgttaatacagtactgtgattttaatttggtttcgtttatttaattaaaatggtcttcaaatttgagctgtgtttgtttgttgatgtgaaaatgtaatttttttgtatctaataacatgagtctggtttatcatgtttcataattggatctagattatgtatgttgaaagtctgttctgaattttgattaacaagtacttttttgttattctgatttattgattacttttggggtatgactcttgtgttgttggatttggtttgatgagatcttgtgtggttaagttgattttaaatttcatgttaatattgataagctgagttggattattgcttgtctgtttcacttattatcatttagcttattacacaatgaattagttgtttggttaagcatgatttgtttattacaatgaaataatttacgaattagcatgataatgacttttgaaactgtcaaatgcggttcaattattttagtgaacatgattcagaagttttgaaactttgcatggattttcatttgttatggttttttactgttgatttctgacttttgtagtttttatgaattgcaggtaagacaaccacaccaccatggatcctaaaaagaaacgtaaggtcatggtgaaggttattggaaggagatctcttggtgtgcaaaggattttcgatattggacttccacaagatcacaacttccttttggctaacggagcaattgctgctaactgcttcaacagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaactcactgagagacccgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagcccaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggccctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaacc

SEQ ID NO: 88 - DNA, 20381 bp, synthetic construct
  misc_feature 1..20381: note = Synthetic
  source 1..20381: mol_type = other DNA
gcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgagctggtctcagttacaatttgagtgttttactcctcatattaacttcggtcattagaggccacgatttgacacatttttactcaaaacaaaatgtttgcatatctcttataatttcaaattcaacacacaacaaataagagaaaaaacaaataatattaatttgagaatgaacaaaaggaccatatcattcattaactcttctccatccatttccatttcacagttcgatagcgaaaaccgaataaaaaacacagtaaattacaagcacaacaaatggtacaagaaaaacagttttcccaatgccataatactcgaaccctagtctttaaaggtcacccgggaaccgcggcttgtacagctcgtccatgccgagagtgatcccggcggcggtcacgaactccagcaggaccatgtgatcgcgcttctcgttggggtctttgctcagggcggactggtagctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcgggcgaagcactgcaggccgtagccgaaggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccattgttataacctttctcttcttcttaggagccatggtggtgtgcgatcgcgagaaatattggttagtatctgatgatccttcaaatgggaatgaatgccttcttatatagagggaattcttttgtggtcgtcactgcgttcgtcatacgcattagtgagtgggctgtcaggacagctcttttccacgttattttgttccccacttgtactagaggaatctgctttatctttgcaataaaggcaaagatgcttttggtaggtgcgcctaacaattctgcaccattccttttttgtctggtccccacaagccagctgctcgatgttgacaagattactttcaaagatgcccactaactttaagtcttcggtggatgtctttttctgaaacttactgaccatgatgcatgtgctggaacagtagtttactttgattgaagattcttcattgatctcctgtagcttttggctaatggtttggagactctgtaccctgaccttgttgaggctttggactgagaattcttccttacaaacctttgaggatgggagttccttcttggttttggcgataccaatttgaataaagtgatatggctcgtaccttgttgattgaacccaatctggaatgctgctaaatattttgatgataacaacgttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaggagttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaccagttacgcaaccttcgtgccacatcgagtattcaacagacacataagctttttgtttttctaacaaaatatggttaaaaaaacaacaatgtaaatgtttacaaacttaaatgactaaattgttattaaaaaaaaacttggggaaatgttaaaaaacgcatttaggacacttgctaaagacttattttttaaaaaacctgtcataaaaagtggtgtattcaatcttactcaactttttgaaagttcgaaatttgttatttccaataccaaattttcatttttccttttcttaactaacatccttggatctcactcgttagcgtgacttagactcttacaacattatcttgtcatacacctctagctttaatgacatcacaattagcatgacctaaaaacttaccggactaacttttttcgaaatgaattgacattgtatgtcggacattatgacctatttgacattatatgtctattaattaataattttttgaagaagaaaccttcatgtttggttttgcccaatatttcacttgggccacactcaaagaaaagcccaaaaaaacaatgtcacagacattacaaacctaaatgaaacgatgtcgtcacaataccttaacctaaccttctttcttattccatccttacctaaaaaactcacaaaagcatattccatccgccactctccaacgttcacattagggtattttcggaaatccaaaattcagcaaggacacttttggaacataaaaatatctgggaccctataaaaacattgtaaccctaggttttttcattctcactcatttctttcactctcaaatatcactccgtctctctctgcggctgagagttcccaaccctagatttcgattcagctgaggtaacaacaatctccgattcttgtttcattgattcgatctatgtttctttgttgttcaattacatgaattaaatgaatctgtttcataattttgttcggttaatttgcatgttttgattttgtttattgtttgagaaatttaatcatgaatgaatcgatttatgattgtaatattggatattgaatttgtttgagctaaattttgtatgagaaattttaattttgaatttaatctgattctgtttattgtttgagaaattttaattatgaatcgatatgattttgtaatatttgattaattctagctaatttaaccgattgttaatctgaaattatagatctgtgtattttgttgttgaaatgatttaattttgtttgaaaagttatgagtttttgatgtttttattgtttaattatggatctgttaatacagtactgtgattttaatttggtttcgtttatttaattaaaatggtcttcaaatttgagctgtgtttgtttgttgatgtgaaaatgtaatttttttgtatctaataacatgagtctggtttatcatgtttcataattggatctagattatgtatgttgaaagtctgttctgaattttgattaacaagtacttttttgttattctgatttattgattacttttggggtatgactcttgtgttgttggatttggtttgatgagatcttgtgtggttaagttgattttaaatttcatgttaatattgataagctgagttggattattgcttgtctgtttcacttattatcatttagcttattacacaatgaattagttgtttggttaagcatgatttgtttattacaatgaaataatttacgaattagcatgataatgacttttgaaactgtcaaatgcggttcaattattttagtgaacatgattcagaagttttgaaactttgcatggattttcatttgttatggttttttactgttgatttctgacttttgtagtttttatgaattgcaggtaagacaaccacaccaccatggatcctaaaaagaaacgtaaggtcatgatgctcaagaagattcttaaaatcgaggaacttgacgaaagggagcttattgacatcgaggtaagtgggaaccacctgttctacgccaacgatatactgacacacaatagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaactcactgagagacccgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagcccaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggccctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaacc

SEQ ID NO: 89 - DNA, 20426 bp, synthetic construct
  misc_feature 1..20426: note = Synthetic
  source 1..20426: mol_type = other DNA
gcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgagctggtctcagttacaatttgagtgttttactcctcatattaacttcggtcattagaggccacgatttgacacatttttactcaaaacaaaatgtttgcatatctcttataatttcaaattcaacacacaacaaataagagaaaaaacaaataatattaatttgagaatgaacaaaaggaccatatcattcattaactcttctccatccatttccatttcacagttcgatagcgaaaaccgaataaaaaacacagtaaattacaagcacaacaaatggtacaagaaaaacagttttcccaatgccataatactcgaaccctagtctttaaaggtcacccgggaaccgcggcttgtacagctcgtccatgccgagagtgatcccggcggcggtcacgaactccagcaggaccatgtgatcgcgcttctcgttggggtctttgctcagggcggactggtagctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcgggcgaagcactgcaggccgtagccgaaggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccattgttataacctttctcttcttcttaggagccatggtggtgtgcgatcgcgagaaatattggttagtatctgatgatccttcaaatgggaatgaatgccttcttatatagagggaattcttttgtggtcgtcactgcgttcgtcatacgcattagtgagtgggctgtcaggacagctcttttccacgttattttgttccccacttgtactagaggaatctgctttatctttgcaataaaggcaaagatgcttttggtaggtgcgcctaacaattctgcaccattccttttttgtctggtccccacaagccagctgctcgatgttgacaagattactttcaaagatgcccactaactttaagtcttcggtggatgtctttttctgaaacttactgaccatgatgcatgtgctggaacagtagtttactttgattgaagattcttcattgatctcctgtagcttttggctaatggtttggagactctgtaccctgaccttgttgaggctttggactgagaattcttccttacaaacctttgaggatgggagttccttcttggttttggcgataccaatttgaataaagtgatatggctcgtaccttgttgattgaacccaatctggaatgctgctaaatattttgatgataacaacgttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaggagttagtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtcacaccaccatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaaccagttacgcaaccttcgtgccacatcgagtattcaacagacacataagctttttgtttttctaacaaaatatggttaaaaaaacaacaatgtaaatgtttacaaacttaaatgactaaattgttattaaaaaaaaacttggggaaatgttaaaaaacgcatttaggacacttgctaaagacttattttttaaaaaacctgtcataaaaagtggtgtattcaatcttactcaactttttgaaagttcgaaatttgttatttccaataccaaattttcatttttccttttcttaactaacatccttggatctcactcgttagcgtgacttagactcttacaacattatcttgtcatacacctctagctttaatgacatcacaattagcatgacctaaaaacttaccggactaacttttttcgaaatgaattgacattgtatgtcggacattatgacctatttgacattatatgtctattaattaataattttttgaagaagaaaccttcatgtttggttttgcccaatatttcacttgggccacactcaaagaaaagcccaaaaaaacaatgtcacagacattacaaacctaaatgaaacgatgtcgtcacaataccttaacctaaccttctttcttattccatccttacctaaaaaactcacaaaagcatattccatccgccactctccaacgttcacattagggtattttcggaaatccaaaattcagcaaggacacttttggaacataaaaatatctgggaccctataaaaacattgtaaccctaggttttttcattctcactcatttctttcactctcaaatatcactccgtctctctctgcggctgagagttcccaaccctagatttcgattcagctgaggtaacaacaatctccgattcttgtttcattgattcgatctatgtttctttgttgttcaattacatgaattaaatgaatctgtttcataattttgttcggttaatttgcatgttttgattttgtttattgtttgagaaatttaatcatgaatgaatcgatttatgattgtaatattggatattgaatttgtttgagctaaattttgtatgagaaattttaattttgaatttaatctgattctgtttattgtttgagaaattttaattatgaatcgatatgattttgtaatatttgattaattctagctaatttaaccgattgttaatctgaaattatagatctgtgtattttgttgttgaaatgatttaattttgtttgaaaagttatgagtttttgatgtttttattgtttaattatggatctgttaatacagtactgtgattttaatttggtttcgtttatttaattaaaatggtcttcaaatttgagctgtgtttgtttgttgatgtgaaaatgtaatttttttgtatctaataacatgagtctggtttatcatgtttcataattggatctagattatgtatgttgaaagtctgttctgaattttgattaacaagtacttttttgttattctgatttattgattacttttggggtatgactcttgtgttgttggatttggtttgatgagatcttgtgtggttaagttgattttaaatttcatgttaatattgataagctgagttggattattgcttgtctgtttcacttattatcatttagcttattacacaatgaattagttgtttggttaagcatgatttgtttattacaatgaaataatttacgaattagcatgataatgacttttgaaactgtcaaatgcggttcaattattttagtgaacatgattcagaagttttgaaactttgcatggattttcatttgttatggttttttactgttgatttctgacttttgtagtttttatgaattgcaggtaagacaaccacaccaccatggatcctaaaaagaaacgtaaggtcatgatgctcaagaagattcttaaaatcgaggaacttgacgaaagggagcttattgacatcgaggtaagtgggaaccacctgttctacgccaacgatatactgacacacaatagctcctccgacgttagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcagacgggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagccaaactcactgagagacccgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagcccaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggccctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaacc

SEQ ID NO: 90 - DNA, 22060 bp, synthetic construct
  misc_feature 1..22060: note = Synthetic
  source 1..22060: mol_type = other DNA
gcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgagctcgcggccgcgctatgaccatgattacgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgagagctcattacgccgcttttgtgtcagagagttcaatcttagctccgagacccgccattaaatccatgaactcggggaaactggttgctatcatagtagcgtcatcaactgtaaccggattctcagaaacaagtcccattaccaagaaggacatagctatacggtgatcgagatgcgtagcaaccgcagccccggatgcgtttccaagccccttaccatctggacgtcctctaacgaccaagctggtttcgccttcgtcgcaatctacaccgttaagcttcagcccgttagcaaccgcggaaagtctgtcggactccttcaccctcaactcttcgagcccgttcatgacggtagctccttcagcaaaggcagcagcgacggccagtattgggtattcatcaatcatagatggagcgcggtcttctgggacagtcacgcctttaagagtagagcttctaactcgtaggtcagcgacatcctcaccaccggctagtcttggattaatcacttcaatgtcagcgcccatctcttgtagtgtcaggattagcccagtccgtgtagggttcatgagcacgttcaagatggtgacatcagagccgggcaccaacagcgcagcaacgagagggaaggcagtactgctagggtcgccggggacgtcgattacttggccagttaactttccgcgtccttccaacctaattgtccgcacgccgtcagcatctgtctcaactgtcagattggctccgaagccttgcagcattttctcagtatgatcccttgtcatgataggttcaatcacggtcgttatcccaggtgtgttcaatccagcgagcaacactgcgctcttgacttgcgcactagccataggcacgcggtaagtgattggtgtaggtgtcttaggtccccgaagggtgacaggcaatctatctccatcctctgacttcacttgaacacccatctccctcaatgggttaagaactcttcccatgggcctttttgtcaaagaagcatctcctataaatgtactatcgaaatcgtacacgcctacaagccccatggtgaggcggcatccggtggctgcatttccgaaatccaacggagcttcaggtgcaagcaggcctccatttccaactccatcaattatccaagtgtctccctcctttctaatcctcgcccccatggcttgcatagcttttccggtattgatcacatcttctccttcgagcagtcccgtgattcgggtctctccactagccaatccaccaaacatgaaggatctatgagaaatacttttgtcccccgggattctcacagtgccactaagtccgctagattttctcgcagtggcaggccttgaggacgctccgtgcgacatgcaggctgtagccactgatgctgaaatcctaaaggaacaaaacttttgcataaaaattgaatcctttttcaaaaccaacatagaatttgctgaatttttcagctttttagatccaaaaacaagaaaacttgagcttttaggtacttggggcttatggaagttggaattgggattaagtgtctggatgccttgagccatgttgttaatctgtgccatggtggtgtgctgaggacctgcaaagttgaaaaccacaaacgaatcagaatgatgaaatttaacagctatccgactgaattaagtacatctcaagaacagatctgattaatttcagggaaaaaaatacataatcttcggtcaggattaaccaaacaaggcggttgttaatggatctgaattttttttttctttaaaataagaagactgttaacggatctgaaaattttcttaaaaagaaaacaattaacgtaataaagaactacagagaaaaattcaagacgtgttattgtaaaagagaaagaaaagattctgacgatcgatgaaactgtacaaaccctatcttaaactcaacaagctaatcgaaaacatgatcattcacgggactaatgaataacatagacaaaataaaatagacgaaccttgaggggagaggtagggaactgcgcaaagagaatgaagtagtttgttttgaattgaactgtgaagagagacagagggtgtgggcctttttatagctaaaggggtggaatcctctccaatcacattgtgacgcgtgtccttgtgtccctatttggtgcttattacacgggtgatatgtggtgtctgatgcgttttcggagtcctttcttggaaattcaggattgcaatttgcggggtggttagcgggttggtaatgttgacggagtcagacgcgcctacgtcagcttaatctgttacaacggcgttattaaattggaccccacttcacaatttgggccggaaccactgcaagtggagcgttctcagttttgtatgggcccctctatccactacaccaacggttggctcctattttacatgattaagaaatctattgcaaagctgtgatgtttgattttttaatggactaatgaatgattggaaagctttatcatttatttttttaataaggaaatgtcttgtaatcatccacgctttaactatttaaacaaatcatgaaacttaaaggtgacggatttaccaataaaataagggtataggacagcttaattgaaaaaacaaaaatgatatagtaaagaaaacttaagagcgatgggcatccttatcatctaatatgaataagctacaccatctgatctgcagtggacaagttgtcagattatacagttgttgatggctttaagaagcataattgtattattaatatttttatatataagtgcagctctattgtttatactactaatattctcgttttgcgttttatttaataattaattgtatgtactttataaaagaaaaatatcataaaatgagaaaaaaaaacaaaaattgactgttatatttgagtgtttttttacttatatgtattatttatatgtattatgctttaatataatatttttattttactaatatagacatatcaacgcgtgtttcaaactgattttttccctctcatctagatggtgttaatgttccttttatcatcaattaaacttgttgagaaacttatttgttatattaggtatgcaatataatattcgtataaattaaaaaacaaaaaattttgagagttgtttttaaaaattgatatatgggtgagtattaaagtttaaatatgtttaagaaatcattctaagatagaatatgcgcgatgaataaataaaatacctattttttaaaaatatgatatgctattttgtagaatacataaaagatgttttgtatgcgctaacaaaaagggtttttgggaaacaaaacacatataatattatttaagatgtaaaaagtttttccagtttttttttttcaaaacataatacataattcattgatcaatataattacaccttagatgcattcgcgcctgcaggtcatcaaaatatttagcagcattccagattgggttcaatcaacaaggtacgagccatatcactttattcaaattggtatcgccaaaaccaagaaggaactcccatcctcaaaggtttgtaaggaagaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattccctctatataagaaggcattcattcccatttgaaggatcatcagatactaaccaatatttctcgcgatcgcacaccaccatgaagactaatctttttctctttctcatcttttcacttctcctatcattatcctcggccgaattcgtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagcatgatgagctttaacctagggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacactcctgcaggatttgaaaaatctcagaattgagattctaggtacctcgcgacctgcagggcatctaaggtgtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtggcgcgcccgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtaggtacctcgcgacctgcagggcatctaaggtgtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtggcgcgcccgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctaagcttggcactgcgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaacc

SEQ ID NO: 91 - DNA, 21688 bp, synthetic construct
  misc_feature 1..21688: note = Synthetic
  source 1..21688: mol_type = other DNA
gcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgagctcgcggccgcgctatgaccatgattacgaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcactagtcattaagaaggaacttcagagttaagatgatcaagagtctcagcgaaagactgccaagcagcctcagtatcagaagttctttgatgttctcctctgaaccattcaacaaactcagcaacatcaagcaaagaccatctcaatctgtaaagagccaaagcagctggatcaggtgtatgtccagtaagttctgtgtatctagcaagagcagcaggatcatcagaaatcaaagaaagatctctttctgggatagcaagaccaacagtatcccaatcaaccaaaacataaccatcctctcccaagataagatttccaggatgtggctctccatgagtaacaaccaaaggagcacctcttcctctaactctagcaaccaattcaccgaactcagccattcttcctctcaaagtagcctcatgttcagccaaaagttctctagcaggttcagagaatggtccacctgtccaagtaccagaaggttcagcaagagcagtatgaactccatcaagaccagttggaaccatatcagttgtaggagtacacttaggaggagcttgtccatgaagctcagccaaaagaacaagaacttgatctctctctctttctgtaagtttctgaccgaactctcctggtctagcagaaacatgtgggaaaacagtcaaagcgtatctagaatcaagaggaaccaaagaagctccatcagatgtagttctaggagcaacaacgaaaggaagacctccttgctctctcaaatgaacagctgtatccatagctcttctaagacctctcaaagcagcaggagcaccatgtccacaatgttccttatgctccaaatcagaaactgtagcgaaccatctttgtccatcatctcctgtgatatgccaatggtaatctccgaaaccaagaggagcgtaagaagcagaagttgtagagattccgaactctctcaatccttggaaaagagactcctgatccaagttttcaggaagatcctccatgcaggctgtagccactgatgctgaaatcctaaaggaacaaaacttttgcataaaaattgaatcctttttcaaaaccaacatagaatttgctgaatttttcagctttttagatccaaaaacaagaaaacttgagcttttaggtacttggggcttatggaagttggaattgggattaagtgtctggatgccttgagccatgttgttaatctgtgccatggtggtgtgctgaggacctgcaaagttgaaaaccacaaacgaatcagaatgatgaaatttaacagctatccgactgaattaagtacatctcaagaacagatctgattaatttcagggaaaaaaatacataatcttcggtcaggattaaccaaacaaggcggttgttaatggatctgaattttttttttctttaaaataagaagactgttaacggatctgaaaattttcttaaaaagaaaacaattaacgtaataaagaactacagagaaaaattcaagacgtgttattgtaaaagagaaagaaaagattctgacgatcgatgaaactgtacaaaccctatcttaaactcaacaagctaatcgaaaacatgatcattcacgggactaatgaataacatagacaaaataaaatagacgaaccttgaggggagaggtagggaactgcgcaaagagaatgaagtagtttgttttgaattgaactgtgaagagagacagagggtgtgggcctttttatagctaaaggggtggaatcctctccaatcacattgtgacgcgtgtccttgtgtccctatttggtgcttattacacgggtgatatgtggtgtctgatgcgttttcggagtcctttcttggaaattcaggattgcaatttgcggggtggttagcgggttggtaatgttgacggagtcagacgcgcctacgtcagcttaatctgttacaacggcgttattaaattggaccccacttcacaatttgggccggaaccactgcaagtggagcgttctcagttttgtatgggcccctctatccactacaccaacggttggctcctattttacatgattaagaaatctattgcaaagctgtgatgtttgattttttaatggactaatgaatgattggaaagctttatcatttatttttttaataaggaaatgtcttgtaatcatccacgctttaactatttaaacaaatcatgaaacttaaaggtgacggatttaccaataaaataagggtataggacagcttaattgaaaaaacaaaaatgatatagtaaagaaaacttaagagcgatgggcatccttatcatctaatatgaataagctacaccatctgatctgcagtggacaagttgtcagattatacagttgttgatggctttaagaagcataattgtattattaatatttttatatataagtgcagctctattgtttatactactaatattctcgttttgcgttttatttaataattaattgtatgtactttataaaagaaaaatatcataaaatgagaaaaaaaaacaaaaattgactgttatatttgagtgtttttttacttatatgtattatttatatgtattatgctttaatataatatttttattttactaatatagacatatcaacgcgtgtttcaaactgattttttccctctcatctagatggtgttaatgttccttttatcatcaattaaacttgttgagaaacttatttgttatattaggtatgcaatataatattcgtataaattaaaaaacaaaaaattttgagagttgtttttaaaaattgatatatgggtgagtattaaagtttaaatatgtttaagaaatcattctaagatagaatatgcgcgatgaataaataaaatacctattttttaaaaatatgatatgctattttgtagaatacataaaagatgttttgtatgcgctaacaaaaagggtttttgggaaacaaaacacatataatattatttaagatgtaaaaagtttttccagtttttttttttcaaaacataatacataattcattgatcaatataattacaccttagatgcattcgcgcctgcaggtcatcaaaatatttagcagcattccagattgggttcaatcaacaaggtacgagccatatcactttattcaaattggtatcgccaaaaccaagaaggaactcccatcctcaaaggtttgtaaggaagaattctcagtccaaagcctcaacaaggtcagggtacagagtctccaaaccattagccaaaagctacaggagatcaatgaagaatcttcaatcaaagtaaactactgttccagcacatgcatcatggtcagtaagtttcagaaaaagacatccaccgaagacttaaagttagtgggcatctttgaaagtaatcttgtcaacatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaagaattccctctatataagaaggcattcattcccatttgaaggatcatcagatactaaccaatatttctcgcgatcgcacaccaccatgaagactaatctttttctctttctcatcttttcacttctcctatcattatcctcggccgaattcgtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagcatgatgagctttaacctagggttcgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacactcctgcaggatttgaaaaatctcagaattgagattctaggtacctcgcgacctgcagggcatctaaggtgtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtggcgcgcccgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtaggtacctcgcgacctgcagggcatctaaggtgtaattatattgatcaatgaattatgtattatgttttgaaaaaaaaaaactggaaaaactttttacatcttaaataatattatatgtgttttgtttcccaaaaaccctttttgttagcgcatacaaaacatcttttatgtattctacaaaatagcatatcatatttttaaaaaataggtattttatttattcatcgcgcatattctatcttagaatgatttcttaaacatatttaaactttaatactcacccatatatcaatttttaaaaacaactctcaaaattttttgttttttaatttatacgaatattatattgcatacctaatataacaaataagtttctcaacaagtttaattgatgataaaaggaacattaacaccatctagatgagagggaaaaaatcagtttgaaacacgcgttgatatgtctatattagtaaaataaaaatattatattaaagcataatacatataaataatacatataagtaaaaaaacactcaaatataacagtcaatttttgtttttttttctcattttatgatatttttcttttataaagtacatacaattaattattaaataaaacgcaaaacgagaatattagtagtataaacaatagagctgcacttatatataaaaatattaataatacaattatgcttcttaaagccatcaacaactgtataatctgacaacttgtccactgcagatcagatggtgtagcttattcatattagatgataaggatgcccatcgctcttaagttttctttactatatcatttttgttttttcaattaagctgtcctatacccttattttattggtaaatccgtcacctttaagtttcatgatttgtttaaatagttaaagcgtggatgattacaagacatttccttattaaaaaaataaatgataaagctttccaatcattcattagtccattaaaaaatcaaacatcacagctttgcaatagatttcttaatcatgtaaaataggagccaaccgttggtgtagtggatagaggggcccatacaaaactgagaacgctccacttgcagtggttccggcccaaattgtgaagtggggtccaatttaataacgccgttgtaacagattaagctgacgtaggcgcgtctgactccgtcaacattaccaacccgctaaccaccccgcaaattgcaatcctgaatttccaagaaaggactccgaaaacgcatcagacaccacatatcacccgtgtaataagcaccaaatagggacacaaggacacgcgtcacaatgtgattggagaggattccacccctttagctataaaaaggcccacaccctctgtctctcttcacagttcaattcaaaacaaactacttcattctctttgcgcagttccctacctctcccctcaaggttcgtctattttattttgtctatgttattcattagtcccgtgaatgatcatgttttcgattagcttgttgagtttaagatagggtttgtacagtttcatcgatcgtcagaatcttttctttctcttttacaataacacgtcttgaatttttctctgtagttctttattacgttaattgttttctttttaagaaaattttcagatccgttaacagtcttcttattttaaagaaaaaaaaaattcagatccattaacaaccgccttgtttggttaatcctgaccgaagattatgtatttttttccctgaaattaatcagatctgttcttgagatgtacttaattcagtcggatagctgttaaatttcatcattctgattcgtttgtggttttcaactttgcaggtggcgcgcccgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctaagcttggcactgcgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaacc

SEQ ID NO: 92 - DNA, 5813 bp, synthetic construct
  misc_feature 1..5813: note = Synthetic
  source 1..5813: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 93 - DNA, 3086 bp, synthetic construct
  misc_feature 1..3086: note = Synthetic
  source 1..3086: mol_type = other DNA
gatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagc

SEQ ID NO: 94 - DNA, 307 bp, synthetic construct; identical to SEQ ID NO: 2
  misc_feature 1..307: note = Synthetic
  source 1..307: mol_type = other DNA

SEQ ID NO: 95 - DNA, 2500 bp, synthetic construct
  misc_feature 1..2500: note = Synthetic
  source 1..2500: mol_type = other DNA
atgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcg

SEQ ID NO: 96 - DNA, 482 bp, synthetic construct; identical to SEQ ID NO: 28
  misc_feature 1..482: note = Synthetic
  source 1..482: mol_type = other DNA

SEQ ID NO: 97 - DNA, 1540 bp, synthetic construct
  misc_feature 1..1540: note = Synthetic
  source 1..1540: mol_type = other DNA
ttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctc

SEQ ID NO: 98 - DNA, 172 bp, synthetic construct; identical to SEQ ID NO: 30
  misc_feature 1..172: note = Synthetic
  source 1..172: mol_type = other DNA

SEQ ID NO: 99 - DNA, 12 bp, synthetic construct
  misc_feature 1..12: note = Synthetic
  source 1..12: mol_type = other DNA
ggggatcctatc

SEQ ID NO: 100 - DNA, 15 bp, synthetic construct
  misc_feature 1..15: note = Synthetic
  source 1..15: mol_type = other DNA
accaggagcggatat

SEQ ID NO: 101 - DNA, 264 bp, synthetic construct; identical to SEQ ID NO: 53
  misc_feature 1..264: note = Synthetic
  source 1..264: mol_type = other DNA

SEQ ID NO: 102 - DNA, 5798 bp, synthetic construct
  misc_feature 1..5798: note = Synthetic
  source 1..5798: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 103 - DNA, 3071 bp, synthetic construct
  misc_feature 1..3071: note = Synthetic
  source 1..3071: mol_type = other DNA
gatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagc

SEQ ID NO: 104 - DNA, 2485 bp, synthetic construct
  misc_feature 1..2485: note = Synthetic
  source 1..2485: mol_type = other DNA
atgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcg

SEQ ID NO: 105 - DNA, 482 bp, synthetic construct; identical to SEQ ID NO: 28
  misc_feature 1..482: note = Synthetic
  source 1..482: mol_type = other DNA

SEQ ID NO: 106 - DNA, 1540 bp, synthetic construct; identical to SEQ ID NO: 97
  misc_feature 1..1540: note = Synthetic
  source 1..1540: mol_type = other DNA

SEQ ID NO: 107 - DNA, 172 bp, synthetic construct; identical to SEQ ID NO: 30
  misc_feature 1..172: note = Synthetic
  source 1..172: mol_type = other DNA

SEQ ID NO: 108 - DNA, 12 bp, synthetic construct
  misc_feature 1..12: note = Synthetic
  source 1..12: mol_type = other DNA
ggggatcctatc

SEQ ID NO: 109 - DNA, 264 bp, synthetic construct; identical to SEQ ID NO: 53
  misc_feature 1..264: note = Synthetic
  source 1..264: mol_type = other DNA

SEQ ID NO: 110 - DNA, 6054 bp, synthetic construct
  misc_feature 1..6054: note = Synthetic
  source 1..6054: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtacaaaaaagcaggcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacaactttgtatacaaaagttgaacgagaaacgtaaaatgatataaatatcaatatattaaattagattttgcataaaaaacagactacataatactgtaaaacacaacatatccagtcactatgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 111 - DNA, 3176 bp, synthetic construct
  misc_feature 1..3176: note = Synthetic
  source 1..3176: mol_type = other DNA
gatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagc

SEQ ID NO: 112 - DNA, 2590 bp, synthetic construct
  misc_feature 1..2590: note = Synthetic
  source 1..2590: mol_type = other DNA
atgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcg

SEQ ID NO: 113 - DNA, 482 bp, synthetic construct; identical to SEQ ID NO: 28
  misc_feature 1..482: note = Synthetic
  source 1..482: mol_type = other DNA

SEQ ID NO: 114 - DNA, 1540 bp, synthetic construct; identical to SEQ ID NO: 97
  misc_feature 1..1540: note = Synthetic
  source 1..1540: mol_type = other DNA

SEQ ID NO: 115 - DNA, 172 bp, synthetic construct; identical to SEQ ID NO: 30
  misc_feature 1..172: note = Synthetic
  source 1..172: mol_type = other DNA

SEQ ID NO: 116 - DNA, 12 bp, synthetic construct
  misc_feature 1..12: note = Synthetic
  source 1..12: mol_type = other DNA
ggggatcctatc

SEQ ID NO: 117 - DNA, 369 bp, synthetic construct; identical to SEQ ID NO: 7
  misc_feature 1..369: note = Synthetic
  source 1..369: mol_type = other DNA

SEQ ID NO: 118 - DNA, 6281 bp, synthetic construct
  misc_feature 1..6281: note = Synthetic
  source 1..6281: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtatacaaaagttgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagaccgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccagctttcttgtacaaagttggcattataagaaagcattgcttatcaatttgttgcaacgaacaggtcactatcagtcaaaataaaatcattatttgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 119 - DNA, 6281 bp, synthetic construct
  misc_feature 1..6281: note = Synthetic
  source 1..6281: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtatacaaaagttgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagaccgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccagctttcttgtacaaagttggcattataagaaagcattgcttatcaatttgttgcaacgaacaggtcactatcagtcaaaataaaatcattatttgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 120 - DNA, 6291 bp, synthetic construct
  misc_feature 1..6291: note = Synthetic
  source 1..6291: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtacaaaaaagcaggcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacaactttgtatacaaaagttgaacgagaaacgtaaaatgatataaatatcaatatattaaattagattttgcataaaaaacagactacataatactgtaaaacacaacatatccagtcactatgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 121 - DNA, 6291 bp, synthetic construct
  misc_feature 1..6291: note = Synthetic
  source 1..6291: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtacaaaaaagcaggcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacaactttgtatacaaaagttgaacgagaaacgtaaaatgatataaatatcaatatattaaattagattttgcataaaaaacagactacataatactgtaaaacacaacatatccagtcactatgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 122 - DNA, 6291 bp, synthetic construct
  misc_feature 1..6291: note = Synthetic
  source 1..6291: mol_type = other DNA
aaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtacaaaaaagcaggcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacaactttgtatacaaaagttgaacgagaaacgtaaaatgatataaatatcaatatattaaattagattttgcataaaaaacagactacataatactgtaaaacacaacatatccagtcactatgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgc

SEQ ID NO: 123 - DNA, 6281 bp, synthetic construct
  misc_feature 1..6281: note = Synthetic
  source 1..6281: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtatacaaaagttgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccagctttcttgtacaaagttggcattataagaaagcattgcttatcaatttgttgcaacgaacaggtcactatcagtcaaaataaaatcattatttgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 124 - DNA, 6140 bp, synthetic construct
  misc_feature 1..6140: note = Synthetic
  source 1..6140: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 125 - DNA, 6281 bp, synthetic construct
  misc_feature 1..6281: note = Synthetic
  source 1..6281: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtatacaaaagttgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccagctttcttgtacaaagttggcattataagaaagcattgcttatcaatttgttgcaacgaacaggtcactatcagtcaaaataaaatcattatttgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 126 - DNA, 6161 bp, synthetic construct
  misc_feature 1..6161: note = Synthetic
  source 1..6161: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 127 - DNA, 4097 bp, synthetic construct; identical to SEQ ID NO: 17
  misc_feature 1..4097: note = Synthetic
  source 1..4097: mol_type = other DNA

SEQ ID NO: 128 - DNA, 6140 bp, synthetic construct
  misc_feature 1..6140: note = Synthetic
  source 1..6140: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 129 - DNA, 6161 bp, synthetic construct
  misc_feature 1..6161: note = Synthetic
  source 1..6161: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 130 - DNA, 4115 bp, synthetic construct
  misc_feature 1..4115: note = Synthetic
  source 1..4115: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgtcgaatacatctagatccaagtacatggattgatcggaatcgagattgcctcggtacaagcaagcgcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatggatcctaaaaagaaacgtaaggtcatgatgctgaaaaaaatcctgaaaatcgaagagctggatgaacgtgaactgatcgatattgaggtgtccggtaaccacctgttttacgctaacgatattctgacccacaacagtagtagtgatgttagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacctagaccaagacttcagctcgcgtcgtcggaatcgagattgcctcggtacaagaacgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 131 - DNA, 4100 bp, synthetic construct
  misc_feature 1..4100: note = Synthetic
  source 1..4100: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgtcgaatacatctagatccaagtacatggattgatcggaatcgagattgcctcggtacaagcaagcgcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatggatcctaaaaagaaacgtaaggtcatgatgctcaagaagattcttaaaatcgaggaacttgacgaaagggagcttattgacatcgaggtaagtgggaaccacctgttctacgccaacgatatactgacacacaatagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacctagaccaagacttcagctcgcgtcgtcggaatcgagattgcctcggtacaagaacgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 132 - DNA, 4106 bp, synthetic construct
  misc_feature 1..4106: note = Synthetic
  source 1..4106: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgtcgaatacatctagatccaagtacatggattgatcggaatcgagattgcctcggtacaagcaagcgcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatggatcctaaaaagaaacgtaaggtcatggtgaaggttattggaaggagatctcttggtgtgcaaaggattttcgatattggacttccacaagatcacaacttccttttggctaacggagcaattgctgctaactgcttcaacagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacctagaccaagacttcagctcgcgtcgtcggaatcgagattgcctcggtacaagaacgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 133 - DNA, 5813 bp, synthetic construct
  misc_feature 1..5813: note = Synthetic
  source 1..5813: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 134 - DNA, 5813 bp, synthetic construct
  misc_feature 1..5813: note = Synthetic
  source 1..5813: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 135 - DNA, 5813 bp, synthetic construct
  misc_feature 1..5813: note = Synthetic
  source 1..5813: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 136 - DNA, 5798 bp, synthetic construct
  misc_feature 1..5798: note = Synthetic
  source 1..5798: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 137 - DNA, 5798 bp, synthetic construct
  misc_feature 1..5798: note = Synthetic
  source 1..5798: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 138 - DNA, 5798 bp, synthetic construct
  misc_feature 1..5798: note = Synthetic
  source 1..5798: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 139 - DNA, 5834 bp, synthetic construct
  misc_feature 1..5834: note = Synthetic
  source 1..5834: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 140 - DNA, 5834 bp, synthetic construct
  misc_feature 1..5834: note = Synthetic
  source 1..5834: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 141 - DNA, 5834 bp, synthetic construct
  misc_feature 1..5834: note = Synthetic
  source 1..5834: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 142 - DNA, 5834 bp, synthetic construct
  misc_feature 1..5834: note = Synthetic
  source 1..5834: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 143 - DNA, 5819 bp, synthetic construct
  misc_feature 1..5819: note = Synthetic
  source 1..5819: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 144 - DNA, 5819 bp, synthetic construct
  misc_feature 1..5819: note = Synthetic
  source 1..5819: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 145 - DNA, 5819 bp, synthetic construct
  misc_feature 1..5819: note = Synthetic
  source 1..5819: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 146 - DNA, 5819 bp, synthetic construct
  misc_feature 1..5819: note = Synthetic
  source 1..5819: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 147 - DNA, 5813 bp, synthetic construct
  misc_feature 1..5813: note = Synthetic
  source 1..5813: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 148 - DNA, 5834 bp, synthetic construct
  misc_feature 1..5834: note = Synthetic
  source 1..5834: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcaccaggagcggatattgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 149 - DNA, 5798 bp, synthetic construct
  misc_feature 1..5798: note = Synthetic
  source 1..5798: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 150 - DNA, 5819 bp, synthetic construct
  misc_feature 1..5819: note = Synthetic
  source 1..5819: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcttggatttgaaaacacaagttcagaccccacaggggatgaaggagatttctaatatccaagtcggtgatctcgtattgagcaatactggatataatgaagtcctgaacgtttttccaaagtcaaaaaagaagagttacaaaataacactcgaagatggcaaagaaataatatgcagcgaagaacacctcttccctacccagactggtgagatgaacatatctggggggttgaaggaggggatgtgtctctatgtaaaggaatgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 151 - DNA, 6044 bp, synthetic construct
  misc_feature 1..6044: note = Synthetic
  source 1..6044: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtatacaaaagttgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagaccgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccagctttcttgtacaaagttggcattataagaaagcattgcttatcaatttgttgcaacgaacaggtcactatcagtcaaaataaaatcattatttgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 152 - DNA, 6044 bp, synthetic construct
  misc_feature 1..6044: note = Synthetic
  source 1..6044: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtatacaaaagttgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagaccgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccagctttcttgtacaaagttggcattataagaaagcattgcttatcaatttgttgcaacgaacaggtcactatcagtcaaaataaaatcattatttgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 153 - DNA, 6054 bp, synthetic construct
  misc_feature 1..6054: note = Synthetic
  source 1..6054: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtacaaaaaagcaggcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacaactttgtatacaaaagttgaacgagaaacgtaaaatgatataaatatcaatatattaaattagattttgcataaaaaacagactacataatactgtaaaacacaacatatccagtcactatgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 154 - DNA, 6054 bp, synthetic construct
  misc_feature 1..6054: note = Synthetic
  source 1..6054: mol_type = other DNA
aaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtacaaaaaagcaggcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacaactttgtatacaaaagttgaacgagaaacgtaaaatgatataaatatcaatatattaaattagattttgcataaaaaacagactacataatactgtaaaacacaacatatccagtcactatgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgc

SEQ ID NO: 155 - DNA, 6044 bp, synthetic construct
  misc_feature 1..6044: note = Synthetic
  source 1..6044: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtatacaaaagttgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccagctttcttgtacaaagttggcattataagaaagcattgcttatcaatttgttgcaacgaacaggtcactatcagtcaaaataaaatcattatttgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 156 - DNA, 5903 bp, synthetic construct
  misc_feature 1..5903: note = Synthetic
  source 1..5903: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtaccatcggaatcgagattgcctcggtacaaggattctaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaagagcgtcggaatcgagattgcctcggtacaaggatatcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 157 - DNA, 5924 bp, synthetic construct
  misc_feature 1..5924: note = Synthetic
  source 1..5924: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggtggaatcggaatcgagattgcctcggtacaaggagcgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagactgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccaagctcggaatcgagattgcctcggtacaagtcagttcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 158 - DNA, 6054 bp, synthetic construct
  misc_feature 1..6054: note = Synthetic
  source 1..6054: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtacaaaaaagcaggcttaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgattacccatacgatgttccagattacgctatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaacaactttgtatacaaaagttgaacgagaaacgtaaaatgatataaatatcaatatattaaattagattttgcataaaaaacagactacataatactgtaaaacacaacatatccagtcactatgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

SEQ ID NO: 159 - DNA, 6044 bp, synthetic construct
  misc_feature 1..6044: note = Synthetic
  source 1..6044: mol_type = other DNA
cgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttcgaatacatctagatccaagtacatggcaaataatgattttattttgactgatagtgacctgttcgttgcaacaaattgatgagcaatgcttttttataatgccaactttgtatacaaaagttgtaggtacctcgcgaatgcatctagatccaatgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctcgcccttacctgctagtcatgggcgatcctaaaaagaaacgtaaggtcatcgataaggagaccgccgctgccaagttcgagagacagcacatggacagcatcgatatcgccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatctgcctttcattcggaaccgaaattttgaccgtggagtatggacctcttccaattggaaagattgtgtcagaagagattaactgttctgtttactcagtggatccagaaggaagagtgtacacccaagctattgcacagtggcatgatagaggagagcaagaagtgcttgagtacgaacttgaggatggttctgtgattagggctacttctgatcacaggttcttgaccactgattaccagttgcttgcaattgaggaaattttcgctaggcaattggatcttttgactcttgagaacattaagcaaactgaggaagctcttgataaccataggcttccatttcctttgcttgatgcaggaactattaagtgataactcgagaagggcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagcattggatcggatcccgggcccgtcgactgcagaggcctgcatgcaaaccagctttcttgtacaaagttggcattataagaaagcattgcttatcaatttgttgcaacgaacaggtcactatcagtcaaaataaaatcattatttgtcgattgtcttcatcggatcccatcccctatagtgagtcgtattacatggtcatagctgtttcctggcagctctggcccgtgtctcaaaatctctgatgttacattgcacaagataaaaatatatcatcatgcctcctctagaccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaccctcgagccacccatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggc

The invention claimed is:

1. A plurality of nucleotide sequences, comprising:
a first nucleotide sequence encoding a first of a first intein fused to at least a portion of a first transcription activator-like effector (TALE);
a second nucleotide sequence encoding a second of the first intein fused to at least a portion of a second TALE, wherein the first TALE includes a first plurality of TALE repeat sequences that, in combination, are configured to bind to a first nucleotide sequence in a target DNA sequence, and the second TALE includes a second plurality of TALE repeat sequences that, in combination, are configured to bind to a second nucleotide sequence in the target DNA sequence, and wherein:
the first nucleotide sequence encodes the first of the first intein comprising an N-terminal intein fused to a C-terminal of the first TALE, and the second nucleotide sequence encodes the second of the first intein comprising the N-terminal intein fused to a C-terminal of the second TALE, or
the first nucleotide sequence encodes the first of the first intein comprising a C-terminal intein fused to an N-terminal of the first TALE, and the second nucleotide sequence encodes the second of the first intein comprising the C-terminal intein fused to an N-terminal of the second TALE; and
a third nucleotide sequence encoding a second intein fused to at least a portion of a rare-cutting nuclease, wherein the third nucleotide sequence encodes the second intein comprising:
a C-terminal intein fused to an N-terminal of the at least portion of the rare-cutting nuclease or between portions of the rare-cutting nuclease, or
an N-terminal intein fused to a C-terminal of the at least portion of the rare-cutting nuclease or between portions of the rare-cutting nuclease, and
wherein:
the rare-cutting nuclease includes FokI,
each of the first nucleotide sequence, the second nucleotide sequence, and the third nucleotide sequence respectively further encode a promoter and a terminator, and the first inteins and the second intein include trans-splicing inteins.

2. The plurality of nucleotide sequences of claim 1, wherein:
the first nucleotide sequence encodes the first of the first intein fused to the first TALE and the second nucleotide sequence encodes the second of the first intein fused to the second TALE; and
the third nucleotide sequence encodes the second intein fused to the rare-cutting nuclease.

3. The plurality of nucleotide sequences of claim 1, wherein:
the first nucleotide sequence encodes the first of the first intein fused to a first portion of the rare-cutting nuclease and the first TALE, and the second nucleotide sequence encodes the second of the first intein fused to the first portion of the rare-cutting nuclease and the second TALE; and
the third nucleotide sequence encodes the second intein fused to a second portion of the rare-cutting nuclease, wherein the first portion and the second portion of the rare-cutting nuclease form the rare-cutting nuclease.

4. The plurality of nucleotide sequences of claim 1, wherein the plurality of nucleotide sequences each include a separate vector or are on a single expression construct.

5. The plurality of nucleotide sequences of claim 1, wherein the first of the first intein and the second intein are configured to self-splice when in contact and, in response, to form a first half transcription activator-like effector nuclease (TALEN) including the first TALE bound to the rare-cutting nuclease.

6. The plurality of nucleotide sequences of claim 5, wherein the second of the first intein and the second intein are configured to self-splice when in contact and, in response, to form a second half TALEN including the second TALE bound to the rare-cutting nuclease.

7. The plurality of nucleotide sequences of claim 1, wherein each of the first of the first intein, the second of the first intein, and the second intein are configured to self-splice when in contact and to form spliced proteins including the first of the first intein bound to one of the second intein and the second of the first intein bound to another of the second intein.

8. A method of transforming a cell, the method comprising:

contacting a cell with:

a first nucleotide sequence encoding a first of a first intein fused to at least a portion of a first transcription activator-like effector (TALE) or a product produced from the first nucleotide sequence;

a second nucleotide sequence encoding a second of the first intein fused to at least a portion of a second TALE or a product produced from the second nucleotide sequence, wherein the first TALE includes a first plurality of TALE repeat sequences that, in combination, bind to a first nucleotide sequence in a target DNA sequence, and the second TALE includes a second plurality of TALE repeat sequences that, in combination, bind to a second nucleotide sequence in the target DNA sequence, and wherein:

the first nucleotide sequence encodes the first of the first intein comprising an N-terminal intein fused to a C-terminal of the first TALE, and the second nucleotide sequence encodes the second of the first intein comprising the N-terminal intein fused to a C-terminal of the second TALE, or the first nucleotide sequence encodes the first of the first intein comprising a C-terminal intein fused to an N-terminal of the first TALE, and the second nucleotide sequence encodes the second of the first intein comprising the C-terminal intein fused to an N-terminal of the second TALE; and a third nucleotide sequence encoding a second intein fused to at least a portion of a rare-cutting nuclease or a product produced from the third nucleotide sequence wherein the first inteins and the second intein include trans-splicing inteins and the third nucleotide sequence encodes the second intein comprising:

a C terminal intein fused to an N-terminal of the at least portion of the care-cutting nuclease or between portions of the rare-cutting nuclease; or an N-terminal intein fused to a C-terminal of the at least portion of the rare-cutting nuclease or between portions of the rare-cutting nuclease, and wherein the rare-cutting nuclease includes FokI and each of the first nucleotide sequence, the second nucleotide sequence, and the third nucleotide sequence respectively further encode a promoter and a terminator; and in response to contacting the cell, splicing the first TALE, the second TALE, and the rare-cutting nuclease by the first of the first intein and the second of the first intein to ones of the second intein to form:

a first half transcription activator-like effector nuclease (TALEN) including the first TALE and the rare-cutting nuclease; and a second half TALEN including the second TALE and the rare-cutting nuclease.

9. The method of claim 8, further including translating the first nucleotide sequence, the second nucleotide sequence, and the third nucleotide sequence to form the first of the first intein fused to the first TALE, the second of the first intein fused to the second TALE, and the second intein fused to the rare-cutting nuclease.

10. The method of claim 8, wherein the first nucleotide sequence encodes an N-terminal intein fused to a C-terminal of the first TALE, the second nucleotide sequence encodes the N-terminal intein fused to a C-terminal of the second TALE, and the third nucleotide sequence encodes a C-terminal intein fused to an N-terminal of the rare-cutting nuclease or the C-terminal intein fused between portions of the rare-cutting nuclease.

11. The method of claim 8, wherein the first nucleotide sequence encodes a C-terminal intein fused to an N-terminal of the first TALE, the second nucleotide sequence encodes the C-terminal intein fused to an N-terminal of the second TALE, and the third nucleotide sequence encodes an N-terminal intein fused to a C-terminal of the rare-cutting nuclease or the N-terminal intein fused between portions of the rare-cutting nuclease.

12. The method of claim 8, wherein splicing includes binding each of the first of the first intein and the second of the first intein to ones of the second intein to form:

a first intermediate including the first of the first intein bound to a first of the second intein, wherein the first of the first intein is fused to the first TALE and the first of the second intein is fused to the rare-cutting nuclease; and a second intermediate including the second of the first intein bound to a second of the second intein, wherein the second of the first intein is fused to the second TALE and the second of the second intein is fused to the rare-cutting nuclease.

13. The method of claim 8, wherein splicing includes:

binding each of the first of the first intein and the second of the first intein to ones of the second intein;

cutting splice sites associated with the first of the first intein, the second of the first intein, and the ones of the second intein; and binding the first TALE to the rare-cutting nuclease and binding the second TALE to the rare-cutting nuclease to form the first half TALEN and the second half TALEN.

14. The method of claim 13, wherein the splice sites are between:

the first of the first intein and the first TALE;

the second of the first intein and the second TALE; and the second intein and the rare-cutting nuclease or portions thereof.

15. An expression construct, comprising:

a first nucleotide sequence encoding a first of a first intein fused to at least a first transcription activator-like effector (TALE);

a second nucleotide sequence encoding a second of the first intein fused to at least a second TALE, wherein the first and the second of the first inteins include trans-splicing inteins, wherein the first TALE includes a first plurality of TALE repeat sequences that, in combination, are configured to bind to a first nucleotide sequence in a target DNA sequence, and the second TALE includes a second plurality of TALE repeat sequences that, in combination, are configured to bind to a second nucleotide sequence in the target DNA sequence and wherein:

the first nucleotide sequence encodes the first of the first intein comprising an N-terminal intein fused to a C-terminal of the first TALE, and the second nucleotide sequence encodes the second of the first intein comprising the N-terminal intein fused to a C-terminal of the second TALE, or the first nucleotide sequence encodes the first of the first intein comprising a C-terminal intein fused to an N-terminal of the first TALE, and the second nucleotide sequence encodes the second of the first intein comprising the C-terminal intein fused to an N-terminal of the second TALE; and a third nucleotide sequence encoding a second intein fused to at least a portion of a rare-cutting nuclease, wherein the second intein comprises a trans-splicing intein and the third nucleotide sequence encodes the second intein comprising:

a C-terminal intein fused to an N-terminal of the at least portion of the rare-cutting nuclease or between portions of the rare-cutting nuclease; or an N-terminal intein fused to a C-terminal of the at least portion of the rare-cutting nuclease or between portions of the rare-cutting nuclease, and wherein the rare-cutting nuclease includes FokI, and each of the first nucleotide sequence, the second nucleotide sequence, and the third nucleotide sequence further encode a promoter and a terminator.

16. The expression construct of claim 15, wherein in response to translation of the first nucleotide sequence, the second nucleotide sequence, and the third nucleotide sequence by a cell, the first of the first intein and the second of the first intein are configured to bind to ones of the second intein and self-splice to form:

a first half transcription activator-like effector nuclease (TALEN) including the first TALE bound to the rare-cutting nuclease;

a second half TALEN including the second TALE bound to the rare-cutting nuclease; and spliced proteins including the first of the first intein bound to one of the second intein and the second of the first intein bound to another of the second intein.

17. The expression construct of claim 15, wherein the first nucleotide sequence, the second nucleotide sequence, and the third nucleotide sequence include separate vectors or are on a single expression construct.

18. The plurality of nucleotide sequences of claim 1, wherein each of the first of the first intein, the second of the first intein, and the second intein are configured to self-splice when in contact and to form a transcription activator-like effector nuclease (TALEN) comprising:

a first half TALEN including the C-terminal or N-terminal of the first TALE bound to the N-terminal or C-terminal of the rare-cutting nuclease; and a second half TALEN including the C-terminal or N-terminal of the second TALE bound to the N-terminal or C-terminal of the rare-cutting nuclease.

19. The expression construct of claim 15, wherein the first nucleotide sequence encodes the first of the first intein comprising the N-terminal intein fused to the C-terminal of the first TALE, the second nucleotide sequence encodes the second of the second intein comprising the N-terminal intein fused to the C-terminal of the second TALE, and the third nucleotide sequence encodes the second intein comprising the C-terminal intein fused to the N-terminal of the rare-cutting nuclease or between the portions of the rare-cutting nuclease.

20. The expression construct of claim 15, wherein the first nucleotide sequence encodes the first of the first intein comprising the C-terminal intein fused to the N-terminal of the first TALE, the second nucleotide sequence encodes the second of the second intein comprising the C-terminal intein fused to the N-terminal of the second TALE, and the third nucleotide sequence encodes the second intein comprising the N-terminal intein fused to the C-terminal of the rare-cutting nuclease or between the portions of the rare-cutting nuclease.

* * * * *